United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 2

SEQ ID NO: 479 - DNA, 2069 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatca

SEQ ID NO: 480 - DNA, 889 bp, Homo sapiens
agttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgt

SEQ ID NO: 481 - DNA, 889 bp, Homo sapiens; identical to SEQ ID NO: 480

SEQ ID NO: 482 - DNA, 889 bp, Homo sapiens; identical to SEQ ID NO: 480

SEQ ID NO: 483 - DNA, 2069 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatca

SEQ ID NO: 484 - DNA, 889 bp, Homo sapiens; identical to SEQ ID NO: 480

SEQ ID NO: 485 - DNA, 2068 bp, Homo sapiens
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcctgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 486 - DNA, 889 bp, Homo sapiens; identical to SEQ ID NO: 480

SEQ ID NO: 487 - DNA, 2069 bp, Homo sapiens; identical to SEQ ID NO: 479

SEQ ID NO: 488 - DNA, 889 bp, Homo sapiens; identical to SEQ ID NO: 480

SEQ ID NO: 489 - DNA, 2068 bp, Homo sapiens; identical to SEQ ID NO: 485

SEQ ID NO: 490 - DNA, 2069 bp, Homo sapiens; identical to SEQ ID NO: 479

SEQ ID NO: 491 - DNA, 864 bp, Homo sapiens
gctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccaggtgggaaacagcagcgaggagaggcccactggggtggaggggccatttcaggagtgctctgggagtgggcgctccattgtaaaatagctgtcactcattgggcctagtgctgtatggtttgtgtagatcatttatggcaaagtcatttttatccatatttatgtttgaagaaaagaggctcagagaggtctggagtctcaaatgtagtaagtaaagaactgggatatgaacaaaagctccttcagtgaggctgaaaaggagcagtgggggtgggg

SEQ ID NO: 492 - DNA, 2019 bp, Homo sapiens
acacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaa

SEQ ID NO: 493 - DNA, 2019 bp, Homo sapiens
acacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaa

SEQ ID NO: 494 - DNA, 2019 bp, Homo sapiens; identical to SEQ ID NO: 493

SEQ ID NO: 495 - DNA, 864 bp, Homo sapiens; identical to SEQ ID NO: 491

SEQ ID NO: 496 - DNA, 864 bp, Homo sapiens; identical to SEQ ID NO: 491

SEQ ID NO: 497 - DNA, 864 bp, Homo sapiens; identical to SEQ ID NO: 491

SEQ ID NO: 498 - DNA, 2146 bp, Homo sapiens
cataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcctgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatctggctaa

SEQ ID NO: 499 - DNA, 2019 bp, Homo sapiens; identical to SEQ ID NO: 493

SEQ ID NO: 500 - DNA, 2146 bp, Homo sapiens; identical to SEQ ID NO: 498

SEQ ID NO: 501 - DNA, 2146 bp, Homo sapiens
cataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaa

SEQ ID NO: 502 - DNA, 864 bp, Homo sapiens; identical to SEQ ID NO: 491

SEQ ID NO: 503 - DNA, 2146 bp, Homo sapiens; identical to SEQ ID NO: 501

SEQ ID NO: 504 - DNA, 2019 bp, Homo sapiens
acacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcctgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatctggctaa

SEQ ID NO: 505 - DNA, 2146 bp, Homo sapiens; identical to SEQ ID NO: 501

SEQ ID NO: 506 - DNA, 864 bp, Homo sapiens; identical to SEQ ID NO: 491

SEQ ID NO: 507 - DNA, 2146 bp, Homo sapiens
cataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaa

SEQ ID NO: 508 - DNA, 864 bp, Homo sapiens; identical to SEQ ID NO: 491

SEQ ID NO: 509 - DNA, 1906 bp, Homo sapiens
aatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaag

SEQ ID NO: 510 - DNA, 8711 bp, Homo sapiens
actccgggctggccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccaggggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccgtgggcatgggtccaggtctgtaacctgaagaagttgttttctgacaatcaccaaatcatccgaatgacatcaaaagcagcccttatctcagagactgagatttctgtggtctcaacttcgctttggtataatttctggcactcaccagcctctatcattatgactttccccccagtgtattatttctctaataggtttccttttcacgttcttttagcacagactggcactttaccctctcagtttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacctctcaccgccccccacccctcactgcccccgattaccctagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagacgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgatttgcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtggtgtg

SEQ ID NO: 511 - DNA, 8688 bp, Homo sapiens
tgtcaggagggcgtagtttgcaaaacatccctcccagtggtactgatgccttttcgcaggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccgtgggcatgggtccaggtctgtaacctgaagaagttgttttctgacaatcaccaaatcatccgaatgacatcaaaagcagcccttatctcagagactgagatttctgtggtctcaacttcgctttggtataatttctggcactcaccagcctctatcattatgactttccccccagtgtattatttctctaataggtttccttttcacgttcttttagcacagactggcactttaccctctcagtttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacctctcaccgccccccacccctcactgcccccgattaccctagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagacgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgatttgcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtggtgtg

SEQ ID NO: 512 - DNA, 2064 bp, Homo sapiens
gtcggaagccgcgctccgccaggcaggagacactgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggaggaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattgg

SEQ ID NO: 513 - DNA, 1690 bp, Homo sapiens
agtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtggtgagacagctttcaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgttttt

SEQ ID NO: 514 - DNA, 3689 bp, Homo sapiens
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacagagacatggttttgctgtgttgctgtgtctgctctcaaactcctggcctcaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 515 - DNA, 3728 bp, Homo sapiens
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagaaatggcataaaataatacatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 516 - DNA, 3492 bp, Homo sapiens
gctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 517 - DNA, 3647 bp, Homo sapiens
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagaaatggcataaaataatacatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 518 - DNA, 3470 bp, Homo sapiens
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagaaatggcataaaataatacatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagtttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 519 - DNA, 3503 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 520 - DNA, 3516 bp, Homo sapiens
agggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 521 - DNA, 1446 bp, Homo sapiens
atggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaa

SEQ ID NO: 522 - DNA, 3576 bp, Homo sapiens
gctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 523 - DNA, 3515 bp, Homo sapiens
ggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 524 - DNA, 3441 bp, Homo sapiens
acaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 525 - DNA, 3362 bp, Homo sapiens
cgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 526 - DNA, 3188 bp, Homo sapiens
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 527 - DNA, 3383 bp, Homo sapiens
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagaaatggcataaaataatacatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 528 - DNA, 8290 bp, Homo sapiens
atgccgctgtccccgccagcccagggcgaccccggggagcccagcccgtgcaggccccctaagaagcacaccaccttccacctctggcgctccaaaaagaagcagcagccggcgccgcctgactgtggggtgttcgttccgcacccgctcccggcgcctgccggagaggccagagctttggatgtagtcgatggaaaatatgtggttcgagactcccaggaatttccactgcactgtggggaatcccagttcttccacaccaccagtgaggcgcttggttccttacttctagagtctggaatatttaaaaagtccagagcacaacctccagaagacaacagaaggaagccagttttggggaaacttggcactctattcactgcaggaaggagaagaaacagtagaaacgggttagagagtcccaccagatcaaatgccaaaccactctctcccaaagatgtggtagcctctcctaagctcccagagagagagagtgagaggagcagatctcagagcagccaactgaagcaaacggacacaagcgaggagggctccccgcgggagaatccccgagaggcagagggcgagctccccgagagcggtggccccgcagccccccctgacgccgagctgtcacctcgctggagcagcagtgcagcggctgtggctgtgcagcagtgccatgaaaatgattcaccccaattagaacctctggaggcagagggagagcctttcccagatgccaccaccactgccaagcagctgcattcctcgccgggaaattcctccaggcaagagaacgcagagacgcccgcccgcagtccgggggaggacgcttcaccaggtgctggccacgaacaggaggctttcctgggtgtgaggggtgcgccagggtcgcccacccaggagcggcccgcgggaggactaggcgaggcccctaacggagcccccagtgtgtgtgccgaagaaggctccctggggccccgcaacgcccgcagccagccccccaagggcgcgtctgatttgccaggtgagcctccggccgagggcgcagcgcacacggccagctccgcgcaggcagactgcacagcccgccccaagggtcacgcccaccctgctaaggtgctaactttggacatctacttgagtaagactgagggggcacaagtggacgagccggtcgtgattactcccagagcggaagattgcggtgactgggacgacatggagaagaggtccagcggccgtaggtcggggaggcggagggggtcgcagaaatccaccgactcccccggcgcggacgccgagctccctgagagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccaaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagaagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaaacctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgatgaaa

SEQ ID NO: 529 - DNA, 7544 bp, Homo sapiens
agatgccaccaccactgccaagcagctgcattcctcgccgggaaattcctccaggcaagagaacgcagagacgcccgcccgcagtccgggggaggacgcttcaccaggtgctggccacgaacaggaggctttcctgggtgtgaggggtgcgccagggtcgcccacccaggagcggcccgcgggaggactaggcgaggcccctaacggagcccccagtgtgtgtgccgaagaaggctccctggggccccgcaacgcccgcagccagccccccaagggcgcgtctgatttgccaggtgagcctccggccgagggcgcagcgcacacggccagctccgcgcaggcagactgcacagcccgccccaagggtcacgcccaccctgctaaggtgctaactttggacatctacttgagtaagactgagggggcacaagtggacgagccggtcgtgattactcccagagcggaagattgcggtgactgggacgacatggagaagaggtccagcggccgtaggtcggggaggcggagggggtcgcagaaatccaccgactcccccggcgcggacgccgagctccctgagagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccaaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagaagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaaacctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatg

SEQ ID NO: 530 - DNA, 1032 bp, Homo sapiens
gagagttaaaccgaagggaatggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaaggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaaacctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgtt

SEQ ID NO: 531 - DNA, 2355 bp, Homo sapiens
tggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaaggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaaacctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagta

SEQ ID NO: 532 - DNA, 594 bp, Homo sapiens
tgcacttgcactctaaggaagctgaggtgggggaggcgggaaagtccacagaggagtttaaagcagccatgccaaaagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgt

SEQ ID NO: 533 - DNA, 1529 bp, Homo sapiens
atagacattttcttctgtggctgctagtgagaacccaaaccagctcagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgtaaggaaggagataaggttcgacttacattcttcacactgtcaaaaaatggagaaaaactacagctgacatctggagttcatagcaccataaaggttattaaggccaaaaaaaaaacatagagaagtaaaaaggaccaattcaagccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattca

SEQ ID NO: 534 - DNA, 832 bp, Homo sapiens
aatataggtgtgttgtagagtcaggcagaacccagaacgtctggagatgaatgtagggaagaaggaaggaccagcaagttcttccaggctggagtacgatggcgcaatctccgctcactgcaatctccactgactacaacctccgcctcccgggttcaagtgattatcctgcctcagcctcctgagtagctgggattacagatacttaactatcaggaaacatttacagatgaagaaagaagaacatctgaacacagactgagcttactggatattgatgccagtggcaatattggcaaacaaatcttgaagatagatggccagagaaatgatggaaactgtgtctgagtcactgcttggaagagagccaccaaaccaggagcacttacatccgactggaatgctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaagcctgaacagaaaca

SEQ ID NO: 535 - DNA, 3046 bp, Homo sapiens
ttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgc

SEQ ID NO: 536 - DNA, 3316 bp, Homo sapiens
ggcctgcggggcggggcctgggccaagcggcccgcaggaggcggcggcggccgttcagtcccttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcaccca

SEQ ID NO: 537 - DNA, 2279 bp, Homo sapiens
gacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggatagggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgc

SEQ ID NO: 538 - DNA, 2172 bp, Homo sapiens
gtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 539 - DNA, 2956 bp, Homo sapiens
ggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaacctgagcctgacattggggggaagtgggaggccccggacggggtagcaccccccattggggctataacggtcaaccatttctgtctcttctttttcccccaacctccccctcctgtcccctctgttcccgtcttccggtcattcttttctcctcctctctccttcctgctgtccttctccggccccgcctctgccctcatcctccctctcgtctttcgcacattctcctgatcctcttgccaccgtcccacgtggtcgcctgcatttctccgtgcgtcctccctgcactcatacccccccttcaacccgcccaaatgtccgatccccgaccttcctcgtgccgtcctcccctcccgcctcgctgggcgccctggccgcagacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcc

SEQ ID NO: 540 - DNA, 2179 bp, Homo sapiens
gaacatcggccgcctccagctcccggcgcggcccggcccggcccggctcggccgcctcagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaa

SEQ ID NO: 541 - DNA, 2218 bp, Homo sapiens
ctctcccctcatctttgccaacctgccccacctcctctgcagctgagcgataacccttgggccgacagtgccctaatctcctccctcctggcttctcgaccgacccttcaccctttccctttctttctcccagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacag

SEQ ID NO: 542 - DNA, 1906 bp, Homo sapiens
cagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 543 - DNA, 1942 bp, Homo sapiens
ggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccggtatgcaggggccagcgggcagcgggaggaggggagtgggagcccgctgtaacccctctcttctccccctagcctcggag

SEQ ID NO: 544 - DNA, 2159 bp, Homo sapiens
tctactccgccgctgcaggtctttgggtcgcgtctgtcactgcgctctgtcgtcggtcggcgtctggcactggaacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 545 - DNA, 585 bp, Homo sapiens
gtccctgcgtttgtctgtgcctgtcactgcatgaggtcgtccgtctgcgcgtgtctgtctccacgggcttctgtccgtctgtctgtcacacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctc

SEQ ID NO: 546 - DNA, 153 bp, Homo sapiens
cctcgcccagcagccttgcgcgtgctaccacgctgtcctgccttctcagacgccgcctgccctgcagccatgaggcccccgcagtgtctgctgcacacgccttccctggcttccccactccttctcctcctcctctggctcctgggtggagga

SEQ ID NO: 547 - DNA, 2259 bp, Homo sapiens
atgctaggcctggtgatgtcatgccccgaccggaccctggtgacgaaagtccgaagtcacccgtcagggaaccagcacagacccacccgcgggggttccagaagtttccactgccgccgcggagtgcctcgcccagcagccttgcgcgtgctaccacgctgtcctgccttctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcc

SEQ ID NO: 548 - DNA, 1761 bp, Homo sapiens
gcggtgcccgcgccgggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatt

SEQ ID NO: 549 - DNA, 3180 bp, Homo sapiens
ggtgtgatctcggctcactgaaacctctgcctcctaggttcaagcgattttcccatgtcagcctccccagtagctgggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctggtgcaaagtaggagccttggggaacatgttaaggggatgtgagagtaagcccacaaagactcagaagtggccagggagtaaggggaaaatgggatagaatagagcaaaagccacgggaggcattccttgaattccttggactcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcatatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaa

SEQ ID NO: 550 - DNA, 1723 bp, Homo sapiens
ggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctg

SEQ ID NO: 551 - DNA, 1785 bp, Homo sapiens
aggctggaggtggacgggacttttggagggtcgctcgcgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatctta

SEQ ID NO: 552 - DNA, 1454 bp, Homo sapiens
agttcccggactggtggctggtctgcagggttgacctgcgcaatgcagaggctgcaggtagtgctgggccacctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggg

SEQ ID NO: 553 - DNA, 1009 bp, Homo sapiens
gttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccggggtaggggtatgagaaagcaggccatggccatgctgggtgctgtactctgggaacctggaatagaccaggcccctctgcaaagtagaagtgggagggctgggatctcctcatccccaccccgatgccttcttaccccaacagtttgcccctaggaaactctag

SEQ ID NO: 554 - DNA, 1268 bp, Homo sapiens
aatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgatcaacatggagtttcttatgtcttccttttctacatacacacggaaatgtgctgcagcctggggccggggcaatcatggcccgaatcgcccagtttctgagtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccggggtaggggtatgagaaagcaggccatggccatgctgggtgctgtactctgggaacctggaatagaccaggcccctctgcaaagtagaagtgggagggctgggatctcctcatccccaccccgatgccttcttaccccaacagtttgcccctaggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcaggtaaggtggctccttcatatagtatctgggtcccacctggatcctgcagctgccctgcatgctgttgccaggggcatgagggtggtcctgtgggtgctgca

SEQ ID NO: 555 - DNA, 1540 bp, Homo sapiens
gggttcccaggccgactctccttgtggttggctgaggctggaggtggacgggacttttggagggtcgctcgcgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtgggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctgggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatctta

SEQ ID NO: 556 - DNA, 9360 bp, Homo sapiens
cagctagcaggcttagattcaggccctcagcaaacaaggaacctggaaaatgtaaccctgaatgcacggtggggaggacatggcaagagaaaagcggcaggaataaagtgattttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcggggatggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaa

SEQ ID NO: 557 - DNA, 9247 bp, Homo sapiens
attttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcggggatggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaagg

SEQ ID NO: 558 - DNA, 9037 bp, Homo sapiens
attttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagcaaggatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcggggatggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaagg

SEQ ID NO: 559 - DNA, 6931 bp, Homo sapiens
ctcccatttcttttgaaaccccctcaaaccctcccctcgcccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcggggatggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaagg

SEQ ID NO: 560 - DNA, 583 bp, Homo sapiens
cttagtcaccctgtgggcgcctgtcagcctcactcaagaatggagctggtggctgcatccccagtgacgattttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggct

SEQ ID NO: 561 - DNA, 3643 bp, Homo sapiens
gatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagggtgcctggggacctggagagatgtgtcttggtggaagataagggccatgttgcccatgcacattggggaaggatcagtgtgactacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttcc

SEQ ID NO: 562 - DNA, 1087 bp, Homo sapiens
agaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtga

SEQ ID NO: 563 - DNA, 989 bp, Homo sapiens
aagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctcca

SEQ ID NO: 564 - DNA, 1388 bp, Homo sapiens
cacacgctttgtgatcccctaatacggttaatgcaaatttctagagtgatccgtctttgtttgagtactgggcaggcagcagggagagtcaggcagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtgggacatggataaagctggaaaccatcattctcagcaaactatcgcaaggacagaaaaccaaacaccgcgtgttctcactcataggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctcca

SEQ ID NO: 565 - DNA, 442 bp, Homo sapiens
gattgcaggctgacctcggtgtgcctgccctgtgttccaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctcca

SEQ ID NO: 566 - DNA, 2472 bp, Homo sapiens
cttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctcctcgccctttcttaaagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgcctttttttttcttactgttttattacaaacttacaaaaatatgtataaccctgttttatacaaactagtttcgtaataaaactttttcctttttttaaaatgaaaataa

SEQ ID NO: 567 - DNA, 1852 bp, Homo sapiens
ctggcggctcttgggactggcggggctgcgcgcggggttagggtgggggtacgggaaggctcaacccaggacctgcgtaccttgctttgggggcgcactaagcacctgccgggagcagggggcgcaccgggaactcgcagatttcgccagttgggcgcactggggatctgtggactgcgtccgggggatgggctagggggacatgcgcacgctttgggccttacagaatgtgatcgcgcgagggggagggcgaagcgtggcgggagggcgaggcgaaggaaggagggcgtgagaaaggcgacggcggcggcgcggaggagggttatctatacatttaaaaaccagccgcctgcgccgcgcctgcggagacctgggagagtccggccgcacgcgcgggacacgagcgtcccacgctccctggcgcgtacggcctgccaccactaggcctcctatccccgggctccagacgacctaggacgcgtgccctggggagttgcctggcggcgccgtgccagaagcccccttggggcgccacagttttccccgtcgcctccggttcctctgcctgcaccttcctgcggcgcgccgggacctggagcgggcgggtggatgcaggcgcgatggacggcggcacactgcccaggtccgcgccccctgcgccccccgtccctgtcggctgcgctgcccggcggagacccgcgtccccggaactgttgcgctgcagccggcggcggcgaccggccaccgcagagaccggaggcggcgcagcggccgtagcgcggcgcaatgagcgcgagcgcaaccgcgtgaagctggtgaacttgggcttccaggcgctgcggcagcacgtgccgcacggcggcgccagcaagaagctgagcaaggtggagacgctgcgctcagccgtggagtacatccgcgcgctgcagcgcctgctggccgagcacgacgccgtgcgcaacgcgctggcgggagggctgaggccgcaggccgtgcggccgtctgcgccccgcgggccgccagggaccaccccggtcgccgcctcgccctcccgcgcttcttcgtccccgggccgcgggggcagctcggagcccggctccccgcgttccgcctactcgtcggacgacagcggctgcgaaggcgcgctgagtcctgcggagcgcgagctactcgacttctccagctggttagggggctactgagcgccctcgacctatgagcctcagccccggaagccgagcgagcggccggcgcgctcatcgccggggagcccgccaggtggaccggcccgcgctccgcccccagcgagccggggacccacccaccaccccccgcaccgccgacgccgcctcgttcgtccggcccagcctgaccaatgccgcggtggaaacgggcttggagctggccccataagggctggcggcttcctccgacgccgcccctccccacagcttctcgactgcagtggggcggggggcaccaacacttggagatttttccggaggggagaggattttctaagggcacagagaatccattttctacacattaacttgagctgctggagggacactgctggcaaacggagacctatttttgtacaaagaacccttgacctggggcgtaataaagatgacctggacccctgcccccactatctggagttttccatgctggccaagatctggacacgagcagtccctgaggggcggggtccctggcgtgaggcccccgtgacagcccaccctggggtgggtttgtgggcactgctgctctgctagggagaagcctgtgtggggcacacctcttcaagggagcgtgaactttataaataaatcagttctgtttacca

SEQ ID NO: 568 - DNA, 1703 bp, Homo sapiens
ccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattgcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggttccgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccac

SEQ ID NO: 569 - DNA, 1840 bp, Homo sapiens
tttcccgttagtcttttcttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggttccgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 570 - DNA, 703 bp, Homo sapiens
agtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcaggtaccgtccttggacttgaagttgtgtgttttgtgtttcagtgggtcattgacagcggtgctgtttctgactggaacgtgggccggtccccagacccaagagctgtgagctgcctaagaaatcatggcattcacacagcccataaagcaagacaggtagacaagctcttgttcaatttctaatatatagagtccagtaacttgagaagtagcgaaaggattaaccagacttgtatattaatgaatgtgtttatttagggtgagcttaaccagctatggtgtgtccattttgtttcacttctggttgcacggtgttgaaagacttgcctgactttggaatttacttattaaaatgcacataaaagctaggtaatttataatgagagagcctgactgtgagctggggct

SEQ ID NO: 571 - DNA, 1549 bp, Homo sapiens
gcgcaggcgcgcggggcaagagggtggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatataaa

SEQ ID NO: 572 - DNA, 1552 bp, Homo sapiens
actgcgcaggcgcgcggggcaagagggtggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatataaa

SEQ ID NO: 573 - DNA, 574 bp, Homo sapiens
atggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagaccaagagctgtgctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtg

SEQ ID NO: 574 - DNA, 593 bp, Homo sapiens
ttgtttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacagggtaagagtggccagcccttccctggggtggtgaggggacagctctggccgtaggcctgctgatgccaggctccttttcccgctgcctgtttccccgcttcgctctacagctgctga

SEQ ID NO: 575 - DNA, 2203 bp, Homo sapiens
aagtaagatggcggcgaacgcacttccggcgtgtgtccttacgggtgcgtccgggcggctgcttgcaggtgccacccagcgggttccagcttgtttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtagggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 576 - DNA, 1499 bp, Homo sapiens
agcttgtttgctgcatagattacaacggtgatggcgggcaagcggtccggctggagccgggcggctctcctccagctccttctcggcgtgaacctggtggtgatgccgcccacccgggcccggagtctgcgcttcgttaccttggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactc

SEQ ID NO: 577 - DNA, 1457 bp, Homo sapiens
gtttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacagggactgagaccctgatccatttttcatagcaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaaca

SEQ ID NO: 578 - DNA, 1340 bp, Homo sapiens
atagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagccca

SEQ ID NO: 579 - DNA, 1699 bp, Homo sapiens
gctcacctgggtcagccctgagccctcgagcagggcggatcggccgctgcctgcttaaagctggggccgccaggagtgcgatcgcctgcggatctgcagctgggcaccggccgcaacgcccgccccgcgacggcagggctgggaatgggggggaccaagcacttcgcagggtgacccggggagatctgtgagccagtggcctcagcgttgaatgagagctctctcccgggtccgcgctcgcagggactgaagggactcctgaatgtccgcgggacgtgtcgcggcggcgcccagcacggaggaggcaggcagggagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactga

SEQ ID NO: 580 - DNA, 1629 bp, Homo sapiens
cgccggggctcacctgggtcagccctgagccctcgagcagggcggatcggccgctgcctgcttaaagctggggccgccaggagtgcgatcgcctgcggatctgcagctgggcaccggccgcaacgcccgccccgcgacggcagggactgaagggactcctgaatgtccgcgggacgtgtcgcggcggcgcccagcacggaggaggcaggcagggagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctg

SEQ ID NO: 581 - DNA, 1556 bp, Homo sapiens
cgccggggctcacctgggtcagccctgagccctcgagcagggcggatcggccgctgcctgcttaaagctggggccgccaggagtgcgatcgcctgcggatctgcagctgggcaccggccgcaacgcccgccccgcgacggcagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctg

SEQ ID NO: 582 - DNA, 1472 bp, Homo sapiens
cccgggacagccctcggagaaactgcatcatcctcactaatgatccacttcctcctcagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctg

SEQ ID NO: 583 - DNA, 3125 bp, Homo sapiens
tcaatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattagtgtgcacagagatctctgtagaaggagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctaggatgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaa

SEQ ID NO: 584 - DNA, 1783 bp, Homo sapiens
gaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctgaacagacagctggataagccaggccaacctcctgtgacacagcatctctcagtggtgccgcatctaaaggacaggcttttgccatgtgggcattgccatcctcacaccctgccttttgaatctgcccagagcagggtctgaactcacagtgacccacaggctgctgctggatgaacactcaggctacctaggtcttctcataatggagtggtagtgcaggctgcttgttcagctagaaagaggctgttatgcataggatggttgtattctctgccacagttgtccggagagaaataagaagccaaactccaatcagccttttacctgcaaagagtgaagggtgagaaggtggacaaagacatagattagaaaaatactggatattgggggaagttagactagaagtattattatacagggtgattcttacgaaagaagacccaatcataaattataaataaactttttatttagcta

SEQ ID NO: 585 - DNA, 1347 bp, Homo sapiens
atggccggcctggggttttggggccaccctgctggacctctcctgctgctgctgctgctggtgctgccaccccgggccctgccagaaggacccctggtgttcgtggctctggtattccgccatggcgaccgggccccgctggcctcctaccccatggacccacacaaggaggtggcctccaccctgtggccacgaggcctgggccagctgaccacggagggggtccgccagcagctggagctgggccgcttcctgaggagccgctacgaggccttcctgagtccggagtaccggcgggaggaggtgtacatccgcagcacggactttgaccgcacgctggagagtgcccaggccaaccttgccgggctgtttcccgaggctgctccagggagccccgaggcccgctggaggccgatcccggtgcacacggtgcccgtggctgaggataagctgctgaggttccccatgcgcagctgtccccgataccacgagctgctgcgggaggccaccgaggccgccgagtaccaggaggccctggagggctggacgggcttcctgagtcgcctggagaacttcacgggactgtcgctggttggagagccactgcgcagggcatggaaggttctggacaccctcatgtgccagcaagcccacggtcttccactaccagcctgggcctccccagatgtcctgcggactcttgcccagatctcggctttggatattggagcccacgtgggcccaccccgggcagcagagaaggcccagctgacaggggggatcctgctgaatgctatccttgcaaacttctcccgggtccagcgcctggggctgcccctcaagatggtcatgtactcagctcatgacagcaccctgctggccctccagggggccctgggcctctatgatggacacaccccgccatatgctgcctgcctcggctttgagttccggaagcacctggggaatcccgccaaagatggagggaatgtcaccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctgggcctgctggcctggagaccagggtgcctgcgggccttggggggccccgtgtgagccagaaaccagggcttccctacccccagctgacactggaccccaacatgtatgctcagtagctgc

SEQ ID NO: 586 - DNA, 1068 bp, Homo sapiens
atggccggcctggggttttggggccaccctgctggacctctcctgctgctgctgctgctggtgctgccaccccgggccctgccagaaggacccctggtgttcgtggctctggtattccgccatggcgaccgggccccgctggcctcctaccccatggacccacacaaggaggtggcctccaccctgtggccacgaggcctgggccagctgaccacggagggggtccgccagcagctggagctgggccgcttcctgaggagccgctacgagggcttcctgagtcgcctggagaacttcacgggactgtcgctggttggagagccactgcgcagggcatggaaggttctggacaccctcatgtgccagcaagcccacggtcttccactaccagcctgggcctccccagatgtcctgcggactcttgcccagatctcggctttggatattggagcccacgtgggcccaccccgggcagcagagaaggcccagctgacaggggggatcctgctgaatgctatccttgcaaacttctcccgggtccagcgcctggggctgcccctcaagatggtcatgtactcagctcatgacagcaccctgctggccctccagggggccctgggcctctatgatggacacaccccgccatatgctgcctgcctcggctttgagttccggaagcacctggggaatcccgccaaagatggagggaatgtcaccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctgggcctgctggcctggagaccagggtgcctgcgggccttggggggccccgtgtgagccagaaaccagggcttccctacccccagctgacactggaccccaacatgtatgctcagtagctgc

SEQ ID NO: 587 - DNA, 753 bp, Homo sapiens
gggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgatgaagaaggttataacgatggagaggtagatgacgaggaagataaaaagaaaaagaaaaaaaaaaaaaaaaaaaaaaaaaaaaaaaaa

SEQ ID NO: 588 - DNA, 2440 bp, Homo sapiens
agtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaa

SEQ ID NO: 589 - DNA, 396 bp, Homo sapiens
atggagatgggcaaatggattcatttagagctgcggaacaggacgccctccgatgtgaaagaacttttcctggacaacagtcagtcaaatgaaggcaaattggaaggcctcacagatgaatttgaagaactggaattattaaatacaatcaacataggcctcacctcaattgcaaacttgccaaagttaaacaaacttaagaagcttgaactaagcagtaacagagcctcagtgggcctagaagtattggcagaaaagtgtccaaacctcatacatctaaatttaagtggcaacaaaattaaagacctcagcacaatagagcccctgaaaaagttagaaaacctcgagagcttagaccttttcacttgcgaggtaaccaacctgaacaactactga

SEQ ID NO: 590 - DNA, 3453 bp, Homo sapiens
ggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgatta

SEQ ID NO: 591 - DNA, 2869 bp, Homo sapiens
agtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgtt

SEQ ID NO: 592 - DNA, 2991 bp, Homo sapiens
gtcagtcggagcggcaggtcgcgagagcagggctggtggccagcggggagcctcgcagaggaaagcatcagtcttgctgaaataagcctagaattggaacgtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaac

SEQ ID NO: 593 - DNA, 1339 bp, Homo sapiens
tgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaacaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttat

SEQ ID NO: 594 - DNA, 3213 bp, Homo sapiens
gattggggtggtagaggcctgagtgggaaaagtttgcaacaaaacaaatttaaatccttttcattttgcagagcaaagtttcggctttaaggtggggaagatacccaaagataaatgcagaatgtaaatgtagagatgtctctgcttttgagttctggctttcttttttttttctttttattttattttctttttctttttcttttttgagatggagtctagctctgtggcccaggctggagtgcagtggcacaatctcggctcactgcaagctctgcctcccgggttcacgccattttcctgcctcagcctctcgagtagctgggactacaggcgcccgccaccacgcctggctaattttttgtatttttaatagagatagggtttcaccgtgttagccaggatggtctcgatctcatgacattgtgatctgcccgcctcggcctcccaaagtgctgggattataggcgtgagccactgcgcccggccgagttctggctttcttaagaaagtgtatctttgtctttcactacagacatggatgggtgcaaaaaagagctgccccgcttgcaagagccggaggaggacgaggattgttacatccttaatgttcagtcaagcagtgatgacaccagtgggtcttctgtggccagaagagctccgaagagacaggcgagttgcatccttaatgtccagtcaaggagtggtgacaccagtgggtcttctgtggccagaagagctccgaagagacaggcgagctccgtggtagtgattgactctgattctgatgaggaatgtcacacccatgaagagaagaaagctaagttattggaaataaacagcgacgatgagagtccggagtgttgtcatgtgaagcctgccatccaggaacctccaatagttattagtgatgatgacaatgacgatgacaacggtaatgatttggaagttcccgacgacaacagtgatgattcagaagctcccgacgacaacagtgatgattcggaagctcctgacgacaacagtgatgattcggaagctcccgacgacaacagtgatgattcggaagctcccgacgacaatagtgatgattcggatgttcccgacgacaacagtgatgattcatccgacgacaacagtgatgattcatccgacgacaacagtgatgattcggatgttcccgacgacaagagtgatgattcggatgttcccgacgacagcagtgatgattcggatgttcccgacgacagcagtgatgattcggaagctcccgacgacagcagtgatgattcggaagctcccgacgacagcagtgatgattcggaagctcccgacgacagcagtgatgattcggaagctcccgacgacagcagtgatgattcggaagcttccgacgacagcagtgatgattcggaagcttccgacgacagcagtgatgattcggaagctcccgacgacaagagtgatgattcggatgttcccgaagacaagagtgatgattcggatgttcccgatgacaatagtgatgatttggaagttcctgtgccagcagaagatttgtgtaatgaaggccaaattgcttcagatgaagaagagctggttgaggctgctgctgctgtctcccagcatgattcatctgatgatgctggtgagcaggatcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactgctggcttatgcagcactggtgagatgtggtacccaaagtggcggcgctttgccaagatccagattggcttgaaagtctgcgactctgcagaccgaatccgggataccttgatccatgaaatgtgccatgctgcctcctggctgattgatggtatccatgattctcatggtgacgcatggaagtattatgccaggaaatccaacaggatacacccggagctgcccagggtcacccgttgccataactataagattaactacaaggtccattatgaatgtactggatgcaaaacgaggattggctgctacaccaaatcgttggacaccagccgcttcatctgtgccaaatgcaaggggtctctggtcatggtgccattaactcagaaagatgggacccgtattgtgccccacgtgtgaccatttgctgtgtatgtgcagaagtattatagaaaaattatgcaggagatggctaggattagccttggggatgtgatgaaaacacttggcaggaattacaaggcaatgaagaattcttaaggttatcttagagtatattaatgtgagctatatcctttactggtaagaagttttagaaaagtttgttttgtgaagttaggaatattagaatttaggtactgttaagtaagtaatgttagaatttaagattcatgttattaacgatgattgaccttaaatagggactctattgctaaccattctgtgcccttgacagggtatttctgaagcccttgggatctaccttgggtcttacttgagttccatatttttcacatgtagaacaaaatgcaaaagaaaagtgagttttcaagagtggcaggttgagagaggagaatgctggaaagaggacaagtttgagaggcaacacttaaacactagggctactgtggcatctatgtagacaggaaagacaaacgtgtttcataaaattcgttgttgatggtattgattgaaactatctgagccatgtaatcaaaaaataaaagttttctgcatctt

SEQ ID NO: 595 - DNA, 2791 bp, Homo sapiens
aaaggggcctgcgcctggcgttgttcatcgcagttgctccggatctttgcacacactccacgggcagttggaggtgagctgctgccggccacgccagaggctgcaacaccagacatggatgggtgcaaaaaagagctgccccgcttgcaagagccggaggaggacgaggattgttacatccttaatgttcagtcaagcagtgatgacaccagtgggtcttctgtggccagaagagctccgaagagacaggcgagttgcatccttaatgtccagtcaaggagtggtgacaccagtgggtcttctgtggccagaagagctccgaagagacaggcgagctccgtggtagtgattgactctgattctgatgaggaatgtcacacccatgaagagaagaaagctaagttattggaaataaacagcgacgatgagagtccggagtgttgtcatgtgaagcctgccatccaggaacctccaatagttattagtgatgatgacaatgacgatgacaacggtaatgatttggaagttcccgacgacaacagtgatgattcagaagctcccgacgacaacagtgatgattcggaagctcctgacgacaacagtgatgattcggaagctcccgacgacaacagtgatgattcggaagctcccgacgacaatagtgatgattcggatgttcccgacgacaacagtgatgattcatccgacgacaacagtgatgattcatccgacgacaacagtgatgattcggatgttcccgacgacaagagtgatgattcggatgttcccgacgacagcagtgatgattcggatgttcccgacgacagcagtgatgattcggaagctcccgacgacagcagtgatgattcggaagctcccgacgacagcagtgatgattcggaagctcccgacgacagcagtgatgattcggaagctcccgacgacagcagtgatgattcggaagcttccgacgacagcagtgatgattcggaagcttccgacgacagcagtgatgattcggaagctcccgacgacaagagtgatgattcggatgttcccgaagacaagagtgatgattcggatgttcccgatgacaatagtgatgatttggaagttcctgtgccagcagaagatttgtgtaatgaaggccaaattgcttcagatgaagaagagctggttgaggctgctgctgctgtctcccagcatgattcatctgatgatgctggtgagcaggatcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactgctggcttatgcagcactggtgagatgtggtacccaaagtggcggcgctttgccaagatccagattggcttgaaagtctgcgactctgcagaccgaatccgggataccttgatccatgaaatgtgccatgctgcctcctggctgattgatggtatccatgattctcatggtgacgcatggaagtattatgccaggaaatccaacaggatacacccggagctgcccagggtcacccgttgccataactataagattaactacaaggtccattatgaatgtactggatgcaaaacgaggattggctgctacaccaaatcgttggacaccagccgcttcatctgtgccaaatgcaaggggtctctggtcatggtgccattaactcagaaagatgggacccgtattgtgccccacgtgtgaccatttgctgtgtatgtgcagaagtattatagaaaaattatgcaggagatggctaggattagccttggggatgtgatgaaaacacttggcaggaattacaaggcaatgaagaattcttaaggttatcttagagtatattaatgtgagctatatcctttactggtaagaagttttagaaaagtttgttttgtgaagttaggaatattagaatttaggtactgttaagtaagtaatgttagaatttaagattcatgttattaacgatgattgaccttaaatagggactctattgctaaccattctgtgcccttgacagggtatttctgaagcccttgggatctaccttgggtcttacttgagttccatatttttcacatgtagaacaaaatgcaaaagaaaagtgagttttcaagagtggcaggttgagagaggagaatgctggaaagaggacaagtttgagaggcaacacttaaacactagggctactgtggcatctatgtagacaggaaagacaaacgtgtttcataaaattcgttgttgatggtattgattgaaactatctgagccatgtaatcaaaaaataaaagttttctgcatcttg

SEQ ID NO: 596 - DNA, 1830 bp, Homo sapiens
tggcgaacggctggccccgggccgcgggcctcaggcaggtccgagggtgcccaggacagggtcggggcttgaatgcctttgcttccgaaaacagcggagccgtggggcctcccccgcgccggccctgcctccaaccagccgcccaatcccggctcccatgcgcgtccacgcctccctataagataaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctac

SEQ ID NO: 597 - DNA, 3533 bp, Homo sapiens
ggggcgagagggggcggagcgtggaggcggcagctggaaccgcgcagcgcacgggaacgcgtcccgctgcttgggtcaggttcgccggtcgcgggagccccgccgtgcagtcggaggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatccttgatgtgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtgaaaa

SEQ ID NO: 598 - DNA, 1956 bp, Homo sapiens
ggggcgagagggggcggagcgtggaggcggcagctggaaccgcgcagcgcacgggaacgcgtcccgctgcttgggtcaggttcgccggtcgcgggagccccgccgtgcagtcggaggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagtttt

SEQ ID NO: 599 - DNA, 3601 bp, Homo sapiens
ggggcgagagggggcggagcgtggaggcggcagctggaaccgcgcagcgcacgggaacgcgtcccgctgcttgggtcaggttcgccggtcgcgggagccccgccgtgcagtcggagagggtgtcactctgagtggtgcttcctcagcccctgtcaaaaagcagtttccaccatcctggagtgtggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatccttgatgtgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtgaaaa

SEQ ID NO: 600 - DNA, 2393 bp, Homo sapiens
atcgcgcggcggccccgggggcgagagggggcggagcgtggaggcggcagctggaaccgcgcagcgcacgggaacgcgtcccgctgcttgggtcaggttcgccggtcgcgggagccccgccgtgcagtcggaggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggatttgaaagacaattaacccaggagaatactgacttatgcctctcaccaccccttctcacctctctctcttctccgttgaagctttggggacagcttttctgccatggagaacaatgcttaggagacttagagaaatag

SEQ ID NO: 601 - DNA, 3597 bp, Homo sapiens
ggggcgagagggggcggagcgtggaggcggcagctggaaccgcgcagcgcacgggaacgcgtcccgctgcttgggtcaggttcgccggtcgcgggagccccgccgtgcagtcggagagggtgtcactctgagtggtgcttcctcagcccctgtcaaaaagcagtttccaccatcctggagtgtggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatccttgatgtgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtg

SEQ ID NO: 602 - DNA, 2741 bp, Homo sapiens
ctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtga

SEQ ID NO: 603 - DNA, 2811 bp, Homo sapiens
ctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggtgaggaaggcggccaggcgacgtggcccctaccctgtgctgggcctgatgggtctccagttgggagtagaagcggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtga

SEQ ID NO: 604 - DNA, 1625 bp, Homo sapiens
ctttaatgcgacctcatctttgtcagtgcacaaaatggcgccctacagcctactggtgactcggctgcagaaagctctggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttc

SEQ ID NO: 605 - DNA, 2675 bp, Homo sapiens
atgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaacc

SEQ ID NO: 606 - DNA, 1433 bp, Homo sapiens
gtgaggtcactaggcttgcaggccaggcagtgccaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctctgcaagagagatatgtggagaaaatcatcattcatgaaaaatacaactctgcgacagagggaaatgacattgccctcgtggagatcacccctcccatttcgtgtgggcgcttcattgggccgggctgcctgccccactttaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagggagacagcggcgggcctctcatgtgcaaagacagcaaggaaagcgcctatgtggtcgtgggaatcacaagctggggggtaggctgtgcccgtgccaagcgccccggaatctacacggccacctggccctatctgaactggatcgcctccaagattggttctaacgctttgcgtatgattcaatcggccacccctccacctcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatatacacacacacatatctgtatgtatacatgcatatac

SEQ ID NO: 607 - DNA, 1158 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 608 - DNA, 1042 bp, Homo sapiens
ctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatg

SEQ ID NO: 609 - DNA, 993 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 610 - DNA, 1023 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcccgctgcgactgaacatgctgaaggtgagcatactgtaggtgagcagccttcaggagaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 611 - DNA, 771 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 612 - DNA, 891 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 613 - DNA, 1113 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 614 - DNA, 1266 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 615 - DNA, 1038 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 616 - DNA, 1056 bp, Homo sapiens
gccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagc

SEQ ID NO: 617 - DNA, 782 bp, Homo sapiens
gcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgac

SEQ ID NO: 618 - DNA, 794 bp, Homo sapiens
ctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcc

SEQ ID NO: 619 - DNA, 2212 bp, Homo sapiens
atcttttaaactttattacaaaaaatatgtgctttttggtaatactttttttttttttttaaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcacacaggctcaagacagacctttttttcccccattaatctagttgcagggtcaacatgagcttccttccacaccgacactaaactgggtgcattgtttaagcattccatatttatgaaagtaaaggagtctccaagggcagagacaacaaagaggaatgcaaagtaggtattaatcttttacagggtgtaaacgtgcaggtacttctgacacccccccttttccatccctacacactcttccatttattatggcatacaaaaactcaactcttctttggctcttgagagtttctagtcttcagtagtccactactaacataatgataatagtataatgattccttatttgctatatattgcagcagttcataatgcttaaatcatttttttcacacacaatgttactgaatcatctatacaggataggagggcaaatggaaatactaaacggtccctcatataagtgttatgttcttcaagatgttttcacatacacggtctcatctgatcctcaggaaagatcccagagtggtagacaggaaagatggcatcatccttttttgcaaataaggaaatgtgacacagagatgttttctttattcatactccatgttgttccaaatttaccaaggttacagagctacagagagctataggcagattccacaaccaaatctgcaagatctaaatctgagctgtttccaccacaatgaaagtagccagaatggttctaagaactcttagaacagtacaacaagaagtcaattttactgtatataaaatttaaaatttcaacatatatacacatcatg

SEQ ID NO: 620 - DNA, 3539 bp, Homo sapiens
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgtgagaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagt

SEQ ID NO: 621 - DNA, 3587 bp, Homo sapiens
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagt

SEQ ID NO: 622 - DNA, 2589 bp, Homo sapiens
acctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaa

SEQ ID NO: 623 - DNA, 2472 bp, Homo sapiens
acctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaa

SEQ ID NO: 624 - DNA, 3396 bp, Homo sapiens
gtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaa

SEQ ID NO: 625 - DNA, 3752 bp, Homo sapiens
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgccccctccacctaccagcaggcacctcgccactcacgtcccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagt

SEQ ID NO: 626 - DNA, 2291 bp, Homo sapiens
gggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcga

SEQ ID NO: 627 - DNA, 2573 bp, Homo sapiens
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgtgagtggttcttttgaagaaggagccgtgatgtgcacaaaatgcctcgcggcaaagaggccccagaactcagagctatccccctacatctaagccttgcctgttaaaaagcatgaaagcaaagcccacaaatctaaggaccgaccggaaggaaatatggggcttttgcagtttgccggcttcccaagaactgtccccgagccagtgtgctaacgagggccacgcctgcatgtcccctcacagatttccaaggtgtgcaagaatgcagaaacccagacctgctcctgggctgtttaggagaaaggcgtccgggctgccgggtggaagtcagggcctgttccctccagagcagacatgggcatggtccggctgatgagtgcagacttggagttggtgatgggcaccatccctgtcccctgtgactcatcctgaacgaggcacagcctcaggcttcatagagagacagtgatggtgtctgcctgaccctaggggtgttttgaagactgaatcaggagtgattttcaaatgtagagaaaactccagataatgctgtttgcttccggccgctgtaaatcataggtgaaaaccagtagcaagtgctcactcagtgcctcccagaagcggtctgcgggtctcagctgggctgggggcagttttcattgggcaaggcttgggcttagcttcgaagcaggggctgggagaggatggatgggggtgtgagagcagaagaaagacctggctttgcagtgaggcagtcccaagttcaaatctgagctcaccactgacccgtcgtgtgatgggcgccaggtgttaggagactggaactgggtatgtgtgtggcattcggccggccatagtagctgctcagtaaacagaaactgtttctcatcctcatcctcatcctcatgcctgcaaactgtaaaccgtcctacttaacaatgaaagtagaaaagtgtttcaatgtgacaggaaagagtgaagacacagaagcttggaaatgatgatgtgttaaagaatcactttaaacaaagaaa

SEQ ID NO: 628 - DNA, 2902 bp, Homo sapiens
gactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagcca

SEQ ID NO: 629 - DNA, 1680 bp, Homo sapiens
atgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctga

SEQ ID NO: 630 - DNA, 2974 bp, Homo sapiens
agaaggggagctgccgccgccgcggtggcactgcctgatgctcggcccagtgtgccggtgccccgctgggtgacagtggactcccagggcgcagcaggagcaggtgacagactgttggctgaaggtgagggtgtccaccctcgcaggcacacgttccagggagcacggcactcaagcagggccgtcagactgggctctggtgcccagaagctgtgcaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattat

SEQ ID NO: 631 - DNA, 3533 bp, Homo sapiens
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaacagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagt

SEQ ID NO: 632 - DNA, 3413 bp, Homo sapiens
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacgtgagcagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagt

SEQ ID NO: 633 - DNA, 7516 bp, Homo sapiens
gggcgcccggctccgctgggggcgggacggcgggcggcgggcggggccgtgtgcgcctgcgtggtgtctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 634 - DNA, 7479 bp, Homo sapiens
ctcccagttgaattttgctgccttaaagcagaagcaaaggagtagtgcatttgttaagaagaagacgcctgaatcttttagtggacctgctttcagcaaacttgttttttaggtcagaatactatatccaatgatcaagctaaacatgaaatgcttcgagtaagactcagtattcatactttgacatttgcaaatcactgggtctaataatactcttcctcttttgttgtcagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccca

SEQ ID NO: 635 - DNA, 7768 bp, Homo sapiens
gggcgcccggctccgctgggggcgggacggcgggcggcgggcggggccgtgtgcgcctgcgtggtgtctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcagctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 636 - DNA, 4177 bp, Homo sapiens
ccgctgggctggcctgagagcgcagcgcgccggccgctaccagccgcgccggagcccctgcgccctgcggcccgctccccggggaccgggccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacaatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctgtgttacaaaagctccaaggatcggcagccacatctgaggttggcactggatacctgcagcatcatctacgtgcccaaggacagccggcacaagaggcacgagctgcgtttcacccagggggctaccgaggtcttggtgctggcactgcagagccgagagcaggccgaggagtggctgaaggtcatccgagaagtgagcaagccagttgggggagctgagggagtggaggtccccagatccccagtcctcctgtgcaagttggacctggacaagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaaatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctggtcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacaaaaggaaagagaaatggagcagctgacatattttaagctcacagtgatactcagtgacaggagcacagagctctaatgtccacaggatgttgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttctatagagggaccaaggacctcaagtcctgggcagtctccttactgtgctactcactactgtctcaacactgtagtgagtctgtctttaacacatttccttccaataaagataaaaccacttaactcttaagtgccagtgcttagctcaagaggaaagaaggaaaatcccagaataaccgtggccactttgctataggggttacatattttaacccacctaaggttttacagactttagcctcactcaaactttatcaccctctgaggtagctggagaccacagcaggaaaaataacctgaccagtaatcacccactgattagtggcagagcgtaggacttaggggttataagcccagatccagatagggctaggtttgagccatgcctctaatgaccagctgggtgaccttgggaaagtcacttgattgctctgattcttgttttccttatctgtgaaatgggactaacaattgttacttttctcccaagattgttgggaagatttaataagataatatatagtaggcatcttgcatagtgtctgagaaataagaaatgctcagtcaatagtggctctcattagccaggcatggtggtactcgcctgtagtcccagctactcaggaggctgaggcaggaggaccgcttgagcccaggagtttgagactgtagtgcactatgatcacgcctgtgaattgccactgcactccagcctaagcaaatagcaagaccccatctattaaaaaaaaaaagtggctattattagctatatcag

SEQ ID NO: 637 - DNA, 2319 bp, Homo sapiens
ccggagcccctgcgccctgcggcccgctccccggggaccgggccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacaatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctgtgttacaaaagctccaaggatcggcagccacatctgaggttggcactggatacctgcagcatcatctacgtgcccaaggacagccggcacaagaggcacgagctgcgtttcacccagggggctaccgaggtcttggtgctggcactgcagagccgagagcaggccgaggagtggctgaaggtcatccgagaagtgagcaagccagttgggggagctgagggagtggaggtccccagatccccagtcctcctgtgcaagttggacctggacaagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaatgggaaatgaagaagacctaggaagaggatgaggatttcattccaaaggaaataccagcttgtccacctgaggaagaaatgcttttttcacaaggagacaccaagagaagac

SEQ ID NO: 638 - DNA, 3705 bp, Homo sapiens
gagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttgaa

SEQ ID NO: 639 - DNA, 3964 bp, Homo sapiens
gtgccaaggcggccgggggcggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatcccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttgaa

SEQ ID NO: 640 - DNA, 3742 bp, Homo sapiens
cagagggttcgagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatggtcactctggcggatttctccccactggagtccccagatgggtgcaggtgcccgaaggagtcatttatgccacgatcaccttggaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatcccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttg

SEQ ID NO: 641 - DNA, 961 bp, Homo sapiens
gcgaggagcgcactccgtggccccgatggagcggtacaaagcacaggggtgttgctgtctggtggtacagagaaggatccggcaggtttctgcgtccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaa

SEQ ID NO: 642 - DNA, 4028 bp, Homo sapiens
gtgccaaggcggccgggggcggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaagcacaggggtgttgctgtctggtggtacagagaaggatccggcaggtttctgcgtccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttg

SEQ ID NO: 643 - DNA, 2932 bp, Homo sapiens
gagcagcgcagaagccgagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgagaatcctgaccttgggccagatctcgggtgcccagagcttttctccagatgggacccacctgacgggaacggagtttcttggaggctggagctggaggcccagccagatcaggctgatgagccctgggacccactggggagaccttactgccacagagattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttc

SEQ ID NO: 644 - DNA, 1413 bp, Homo sapiens
cctctggggttttatattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttacttctctgtgtggggctcttttttcctgggctatgtctcatacacagtgctaaggacttttcacacattacttttaatccatgcaatagtgctgtaaggtaggtgctatcattatacccatattacagatgaggaaattgaggctcagagaagtcaaggacttgcgaagatcacacagattccagattaaaattcaagtatctgactgcaaa

SEQ ID NO: 645 - DNA, 1565 bp, Homo sapiens
gtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaa

SEQ ID NO: 646 - DNA, 1702 bp, Homo sapiens
ctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcgaccagtctgtcttgattactatagcttggtgagattgccctcagtcccaataatcacgaagtgcacatctataagaagaacgggagccagtgggtgaaagctcatgaactcaaggagcacaacggacacatcacagggtatgcatatctgcagtgcagtgttgccaggcctcatcagattgccatcattcccacctgtcctgtatgagagtgctcattttcccacaccccgccacatacttgagatgggaagactgaagaatgcatgaaaggttcatccattgcttctgtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctg

SEQ ID NO: 647 - DNA, 1551 bp, Homo sapiens
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaa

SEQ ID NO: 648 - DNA, 572 bp, Homo sapiens
acagttggcgcccaccggcatcagcgtgaagggagctcctcgctggctgccgacggggctgcagggctcgctagccgctcacctgcgtgtgagcgcggagcccgcagtacccgccgtccgggctcagaggacgtgactccccgaccctgcgcccggcagtccccgggggccgtgcgcccggcccaggctcggaggtccagcccagcggcggctcaggctgcgcgcctggctcccagcctcagtttccccattggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtg

SEQ ID NO: 649 - DNA, 559 bp, Homo sapiens
agagccggttcggcgcgtcgactgcccagagtccgcggccggggcgcgggagtgtcttgttctgttgcccaggctggagtgtggtgacactaccttgactcactgcagcatctgcctcccgggttccagtgattctcctgcctcagcctctcaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactg

SEQ ID NO: 650 - DNA, 593 bp, Homo sapiens
cagagccggttcggcgcgtcgactgcccagagtccgcggccggggcgcgggaggtgaacctaacttcctggcctccaagatttggggtcagagtcccaagctgcgtcatttagtagaagccgagtgactttgaacaaatcgttgcttttgtctgagcctgggtttcctcctgtacaaactgaagtgtcttgttctgttgcccaggctggagtgtggtgacactaccttgactcactgcagcatctgcctcccgggttccagtgattctcctgcctcagcctctcaggtagctgggattacaggtacatgccaatatgcccggctaatttttagagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaaggg

SEQ ID NO: 651 - DNA, 545 bp, Homo sapiens
agagccggttcggcgcgtcgactgcccagagtccgcggccggggcgcgggaggctggagtgtggtgacactaccttgactcactgcagcatctgcctcccgggttccagtgattctcctgcctcagcctctcaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggt

SEQ ID NO: 652 - DNA, 348 bp, Homo sapiens
agagccggttcggcgcgtcgactgcccagagtccgcggccggggcgcgggaggctggagtgtggtgacactaccttgactcactgcagcatctgcctcccgggttccagtgattctcctgcctcagcctctcaggtagctgggattacaggtccctgtgatgctgggaaactgagtcacggaggcggggagagatgtgtttgaggaattgggctgagaccgtgatctcacccccgtcaggcctggtgggctcctttgacactcagcggcaggagccaagccgccatggcctaccacagcttcctggtggagcccatcagctgccacgcctggaacaaggaccgcaccc

SEQ ID NO: 653 - DNA, 581 bp, Homo sapiens
agagccggttcggcgcgtcgactgcccagagtccgcggccggggcgcgggagtgtcttgttctgttgcccaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggt

SEQ ID NO: 654 - DNA, 669 bp, Homo sapiens
cagggcctgcacagttggcgcccaccggcatcagcgtgaagggagctcctcgctggctgccgacggggctgcagggctcgctagccgctcacctgcgtgtgagcgcggagcccgcagtacccgccgtccgggctcagaggacgtgactccccgaccctgcgcccggcagtccccgggggccgtgcgcccggcccaggctcggaggtccagcccagcggcggctcaggctgcgcgcctggctcccagcctcagtttccccattggtaaagcattgacggtggttgcggacggcttctgcggacagagccttgggctccgacgtctgcgcgggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaa

SEQ ID NO: 655 - DNA, 1715 bp, Homo sapiens
agagccggttcggcgcgtcgactgcccagagtccgcggccggggcgcgggagtgttcccccaggtgaacctaacttcctggcctccaagatttggggtcagagtcccaagctgcgtcatttagtagaagccgagtgactttgaacaaatcgttgcttttgtctgagcctgggtttcctcctgtacaaactgaagtgtcttgttctgttgcccaggctggagtgtggtgacactaccttgactcactgcagcatctgcctcccgggttccagtgattctcctgcctcagcctctcaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactg

SEQ ID NO: 656 - DNA, 580 bp, Homo sapiens
gctgctgctccggcgcggagcccagagccggttcggcgcgtcgactgcccagagtccgcggccggggcgcgggagacagtgtcttgttctgttgcccaggctggagtgtggtgacactaccttgactcactgcagcatctgcctcccgggttccagtgattctcctgcctcagcctctcaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaa

SEQ ID NO: 657 - DNA, 561 bp, Homo sapiens
agagccggttcggcgcgtcgactgcccagagtccgcggccggggcgcgggaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggt

SEQ ID NO: 658 - DNA, 1605 bp, Homo sapiens
gcggcggcggcggctcggcaggcgggttcaggcttcgggggccaggtcggttgggtgggtgggtgtctccacagtctgcgtgcgtgggccagcgcgttcgtcttacccttccctccaccccggcccctctccccttctcccctaacctcctaccccacccagccccactcagggggcagcagggccgctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttacatgagaa

SEQ ID NO: 659 - DNA, 1505 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 660 - DNA, 482 bp, Homo sapiens
gagcggaagtggccggctagagccgggggctgggcggggaccgggcttgtcggtgaagcggcagtggcggcggcggcggcggctcggcaggcgggttcaggcttcgggggccagccccactcagggggcagcagggccgctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcagg

SEQ ID NO: 661 - DNA, 1221 bp, Homo sapiens
accgcagcggacagcgccaagtgaagcctcgcttcccctccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 662 - DNA, 762 bp, Homo sapiens
atgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttc

SEQ ID NO: 663 - DNA, 1381 bp, Homo sapiens
accgcagcggacagcgccaagtgaagcctcgcttcccctccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgc

SEQ ID NO: 664 - DNA, 1227 bp, Homo sapiens
ggccaccgcagcggacagcgccaagtgaagcctcgcttcccctccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcg

SEQ ID NO: 665 - DNA, 1491 bp, Homo sapiens
accgcagcggacagcgccaagtgaagcctcgcttcccctccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 666 - DNA, 2755 bp, Homo sapiens
cacactcattttagccagtgtccaggctatcagcagagaaagacaggtgggcagcatggctccgggcgaaaaggaaagcggggagggcccagccaagagcgccctccggaagatacgcacagccaccctggtcatcagcttggcccgaggttggcagcagtgggcgaatgagaacagcatcaggcaggcccaggagcctacaggctggctgccgggagggacccaggactcacctcaagctcctaaaccaatcacaccccctacttcacaccagaaagctcagagtgccccaaagtcgccaccccgcctgccagaaggacatggagatggacaaagctcagagaaagcccctgaggtttctcacatcaaaaagaaagaggtgtccaaaacggtggtcagcaagacttatgagagaggaggggacgtgagccacctcagccacaggtacgagagggatgctggtgtgcttgaacctgggcagccagagaatgacattgacagaatcctccacagccacggctccccaacgcggaggagaaaatgtgccaacctggtgtctgagctaaccaagggctggagagtgatggagcaggaggagcccacatggaggagtgacagcgtagacacagaggacagcggctatggaggagaggctgaggagaggcccgagcaggatggagtgcaggtggctgtggtcaggatcaagcgccccttgccctcccaggtaaacagatttacagagaaactcaactgcaaagcccaacagaaatatagcccagtgggcaacttgaaagggagatggcagcagtgggctgatgaacacatacaatcccagaagctcaatcctttcagtgaagagtttgattacgagctggccatgtccacccgcctacacaaaggagatgagggctatggccgccccaaagaaggaaccaaaactgctgaaagggccaagcgtgctgaggagcacatctacagggaaatgatggacatgtgcttcattatctgcacaatggctcgccacagacgagatggcaagatccaggttacttttggagatctctttgacagatacgttcgtatttcagataaagtagtgggcattctcatgcgtgccaggaaacatggactggtagactttgaaggagagatgctatggcaaggccgagatgaccatgttgtgattacgctactcaagtgaaccttcaaaaacaaaagccaaatttggcccactatggtcttaatgctaaatgctcatgtaggtaaaatgaaaatgcaaactctctgtaataagttagtaaatattaaacaatttttacataaacgactttctggcattctatttctatctagaatgaggaattttggagattttgagaaggcacaaagcatttcagaaagcacatagaatgttaatgtataataatagtattaatagttgaaattccacagggtgtttttgtttttgttttgagacagattctctttatgtcaccaaagctggtcttttaactcctggcctcaagtgatcctctcacctcagcctcccaagtagctgggattataggcatgagcaacagcacccagccacttgtatattttaggcaaaatatttagctagtcattgtagaaactactatagatttttaattaaacattacatctaagaagaatgctgacttgagataaatatcagtagaacatataataatgtgtctttatttggaaaaaagaaaataccattaagtttggtaaaactaaacttaaaattttttcagaagcttgactttgtattattgtttatatcatagcatcacttacaaaacaagcacatatataaaaagttgtcaagatgttgctgaaattgttgaagttcctctgtgggcttggattctaacaggtttccagtaagagttcaccttcctcttgtttgatttcagcaaatcacataaaaacagacacttcctgtcttagtaccaacaaaggaaggcacaccctcactaaaagtagagcagaggtgagagattcagatttacttgcctttgtaggacttcttggagaagtttattgtttcattacatgtcagcatataacgagtcaagctgcttgcattaacatcaatgcaatgatatgtatttctccaacaatggagaaatacagaaaatctatgaagtggaatgttcagtattagaaaaatcccatagaatcattggtgaattaaaaacagatttgagacagtttaatgttcctcatactgtaacaaagaaaactttatgaaatgtttaagtcataaaactgcaatattagttctgccaaagtaaaaaatatacaatgatgatggcaaggagaaaatcattggacattaatgtgcctatgtgatcttaaaaacaaatggaatggaatgtgagattgcaattcttactggattcaatgaaattactaaaatgcattgatagtatagcactttggtgttaaatgtaaaaattaatgtctaaatatgatacctcaaaataataggtattagactgctataagaattatatttgttttcatgtatgagtctctttcaaactgaaggttctggtatcttaagaaagtatgcgtattttgtttccataccgtatttataaagctataagttaatgaccaatatttctaagtaggatttcatgtaagatgcacacttctattacaagtgaaacctacgccaaatgttaaagacaaatagcataagaataaaagatgttttcttgta

SEQ ID NO: 667 - DNA, 4863 bp, Homo sapiens
gcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttataaaagaaaaaa

SEQ ID NO: 668 - DNA, 2905 bp, Homo sapiens
gacgggcggcgcggctattaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagatttagtatacactgccagacccgatgaaagagccataatgacttatgtttcctgttactatcatgcttttgctggtgcacagaaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtga

SEQ ID NO: 669 - DNA, 3631 bp, Homo sapiens
agcacactcagctctgtggaaggacctccagaaagttctacatgttcatatcaggagatgaggaggtcttcagtgaattcaagtgcaatggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgcc

SEQ ID NO: 670 - DNA, 1994 bp, Homo sapiens
tattaacctggccatggaaatcgctgagaagcacctggatattcctaaaatgttggatgctgaagatttagtatacactgccagacccgatgaaagagccataatgacttatgtttcctgttactatcatgcttttgctggtgcacagaaggccgagacagcggctaacaggatatgtaaggttcttgctgtgaatcaagagaatgagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagca

SEQ ID NO: 671 - DNA, 1440 bp, Homo sapiens
agaatggagataagattcagaggttgaggatggggtgtcctggtggactgaaggtagcctactagctgtacatgggtgacaacttgaaacttcagaaccctgaagtttaaaaaattctaaaggtgcctgtcatctcagagagtgacgtaagtgttctttctttatttgggggaagtccaggagaacatattacagacatgtttaatccacatgcattagatgttcctgctgtaatttttgacaatggttcaggactctgcaaagcaggcctgtctggagagattggaccccgccatgtcatcagctccgtcttgggacattgtaaattcaatgtgcctttagcaagacttaatcagaagtacttcgtggggcaagaagccctgtacaagtatgaggccctacatttgcactaccccattgagcgtggactggtaacaggatgggatgacatggagaaactctggaaacatctctttgagcgggagcttggagtaaaacccagccaacagcctgtacttatgaccgagccctctttgaatcctagggaaattcgagaaaagctagcagaaatgatgtttgagaccttcagtgtgcctggtttctacctgtctaatcatgcggtggcagcgctctatgcctctgcctgtgtcacaggcctggtggtggacagtggagatggggtcacttgcactgtccccatctttgagggttactccctgcctcacgcagtcaccaaactctgtatggcagggagggacatcacagagcacctcacccggctcctctttgctagcgggtttaacttcccttgcatactcaacaaggccgtggtaaataacatcaaagagaagttgtgctacatcgccttggagccagagaaagagctacgcaagagccggggagaggtcctgggagcatacagactgccagatggacatgtcatccactttggggatgagctgtaccaagtgcccgaggttctttttgcacctgaccagctgggcatccacagcccaggactctcaaaaatggtctccagcagcatcatgaagtgtgacactgacatccagaataaactttatgcagacattgtactctccgggggcaccactctcctccctgggctggaggaaaggctcatgaaggaagtggaacagctggcttccaaaggtactcccatcaagatcacagcttctcctgatagatgcttctctgcatggattggtgcatccatcatgacctctatgagcagtttcaagcagatgtgggtcacctcggcagacttcaaggagtatgggacatctgtggttcaaagaaggtgcttttaaagatccttgagcagaggagacatcttgaagtgtcagattacaggagtaccagtgggagatggcattttcttctgggcttcagcatgatgttcaataaaagttttgccatttc

SEQ ID NO: 672 - DNA, 1420 bp, Homo sapiens
tggaagaggcctcagcaggcccaggccacctggagggagagcagacctgcggctgaggatgcagggctcccgggcacggtgctagccctgccttgagacaccccgagagctgtgggaagagctgtgggatcccctattgcatcacaaagcggccctggagggctggtctttattttgatgaggctgagaagggaaggctgcgggcatgtttaatccgcacgctttagactccccggctgtgatttttgacaatggctcggggttctgcaaagcgggcctgtctggggagtttggaccccggcacatggtcagctccatcgtggggcacctgaaattccaggctccctcagcagaggccaaccagaagaagtactttgtgggggaggaggccctgtacaagcaggaggccctgcagctgcactcccctttcgagcgtggcctgatcacagggtgggatgacgtggagagactctggaagcacctctttgagtgggagctaggcgtgaaacccagcgaccagcccctgcttgcaacggagccctccctgaaccccagggagaaccgtgagaagatggcagaagtcatgttcgagaacttcggcgtgcccgctttctacctgtcggaccaggcggtgctggctctctacgcctctgcctgtgtcacgggcctggtggtggacagcggggatgcggtcacctgcactgtccccatctttgagggttactccctgccccacgcagtcaccaagctccacgtggcgggcagggacatcacggagctcctcatgcagctgctcctggccagcggccacaccttcccctgccagctggacaagggtctcgtggacgacatcaaaaagaagctgtgctacgtggccttggagcccgagaaggagctttcccggaggccggaggaggtcctgagggagtacaagctgcccgacgggaacatcatcagcctcggggacccgctgcaccaggcgcccgaggccctgttcgtgccccagcagctgggcagccagagccccgggctctcgaatatggtctccagcagcatcaccaagtgtgataccgacatccagaagatcctctttggggagattgtgctgtcggggggcactaccctgttccacgggctggatgaccggcttctcaaggagctggagcagctggcctccaaggacacccccatcaagatcacggctccccccgaccggtggttctccacctggattggagcctccatcgtcacctctctgagtagcttcaagcagatgtgggtcaccgccgcagacttcaaggagtttgggacctccgtggtgcagagaagatgcttctgaaggccgcttctcgttgggtaccgtggggggtgaaccctagccccagctttgggaggatgttcaataaaggaccaatgccgg

SEQ ID NO: 673 - DNA, 987 bp, Homo sapiens
atgtttaatccgcacgctttagactccccggctgtgatttttgacaatggctcggggttctgcaaagcgggcctgtctggggagtttggaccccggcacatggtcagctccatcgtggggcacctgaaattccaggctccctcagcagaggccaaccagaagaagtactttgtgggggaggaggccctgtacaagcaggaggccctgcagctgcactcccctttcgagcgtggcctgatcacagggtgggatgacgtggagagactctggaagcacctctttgagtgggagctaggcgtgaaacccagcgaccagcccctgcttgcaacggagccctccctgaaccccagggagaaccgtgagaagatggcagaagtcatgttcgagaacttcggcgtgcccgctttctacctgtcggaccaggcggtgctggctctctacgcctctgcctgtgtcacgggcctggtggtggacagcggggatgcggtcacctgcactgtccccatctttgagggttactccctgccccacgcagtcaccaagctccacgtggcgggcagggacatcacggagctcctcatgcagctgctcctggccagcggccacaccttcccctgccagctggacaagggtctcgtggacgacatcaaaaagaagctgtgctacgtggccttggagcccgagaaggagctttcccggaggccggaggaggtcctgagggagtacaagctgcccgacgggaacatcatcagcctcggggacccgctgcaccaggcgcccgaggccctgttcgtgccccagcagctgggcagccagagccccgggctctcgaatatggtctccagcagcatcaccaagtgtgataccgacatccagaagatcctctttggggagattgtgctgtcggggggcactaccctgttccacgggctggatgaccggcttctccacctggattggagcctccatcgtcacctctctgagtag

SEQ ID NO: 674 - DNA, 4701 bp, Homo sapiens
agagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 675 - DNA, 2496 bp, Homo sapiens
gttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatg

SEQ ID NO: 676 - DNA, 2496 bp, Homo sapiens; identical to SEQ ID NO: 675

SEQ ID NO: 677 - DNA, 4189 bp, Homo sapiens
gcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccg

SEQ ID NO: 678 - DNA, 1501 bp, Homo sapiens
ctttctaccctcaatgccgagcacagaacctggggcagtgtttccactgtgcttccagtcccgagcatttcggatgaatgaatgatgaacaaacgacagaacgcagggcgagcagctcagcaaaggtcatgcaggagatagagaagcgctgtgtcatgagtattggatcattatggatttttttctttctcattgtgcagatctattcgcacaactctatcttcaaccagtttgccaggcccaccggaggtgcccagtaaaattttgtcaaacaaatactgatgatgaagtatcctgggacttggccctgtcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagca

SEQ ID NO: 679 - DNA, 2002 bp, Homo sapiens
ctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 680 - DNA, 2270 bp, Homo sapiens
ctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataatctcattcacttgaacacatcaaacgactgtgggttccagaagataactttggattgtcagaatatttatacttggaagtccaggcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacaggtgtctctgatgcatattctcagagcctaccaggaaaatcctagaatcgagaagggcttgggacacagagagctagtggttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 681 - DNA, 2308 bp, Homo sapiens
gagacggagtttccctcttgttgcccaggctggaaatggcgcgatctcggctcacagcaacctctgcctcccggatttaagcgattctcctgcttcagcctcccgagtagctgggattacaggcatgcaccaccatgcctggctaattttgtatttctagtagagatggggtttctccatgttggtcaggctggtcttgaactcccgacctcaggtgatccacctgccttggcctcccaaagtgctgggattacaggcgtgagccactgcacctgcagccgcctagtcctcttctccttctctttgatgattcagggcctcggcttccctcacgatattgcagaaagacacagctttcctcttcctctccaaaccacctcgaagcaggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 682 - DNA, 1311 bp, Homo sapiens
aatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataatctcattcacttgaacacatcaaacgactgtgggttccagaagataactttggattgtcagaatatttatacttggaagtccaggcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacaggtgtctctgatgcatattctcagagcctaccaggaaaatcctag

SEQ ID NO: 683 - DNA, 2076 bp, Homo sapiens
ggaattccgggtcctcctcctcgccctaccttggtttacctgcagccgcctagtcctcttctccttctctttgatgattcagggcctcggcttccctcacgatattgcagaaagacacagctttcctcttcctctccaaaccacctcgaagcaggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgccttttac

SEQ ID NO: 684 - DNA, 1798 bp, Homo sapiens
ctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttt

SEQ ID NO: 685 - DNA, 2823 bp, Homo sapiens
agatgctgcatttgctgtctccgcgacaactgcctgttcttccggagctcgtggtctgagggcccgactttcatcttagtctgtttttgtggggaacattttttttttaagcttttcctttgaaagtcttttttcgttgagaactttagaggcctcggggaataggccactgggttgtgatgtcatcgagtattgctaatgatgtgcccttttcctccatccatgtcggtttaccttctgtgttgttatttctcacgaaacctcttcttggttctgtaagcgcacaactcatcaattattattttatttatttttttgagacgaagtctcgctctgtcgcccaggctggagtgcagtggcgcgatctcagctcactgcaacctccgcctctcaggcttaagccattctcgtgcctcagctttcccagtagttgggactacaggcgcccgccaccacacccggctactttctgtattttcagtagagacggggtttcatcatgttggcctggctggtctcgaactcctggcctcagatgatccgcctcggcctcctaaagtgctgggattacagacgtgagccaccgcgcccacgttggcttgaacattagtgtatttagtaaggatcaacttgttttctttggaacttttaagtattttgggcttcaagactatctaagctgtacgtggtaggaatattggttgaatttaacctcagctagcctgtaaggaacctttgtttcctaaattattgattcattaagtgatgtgaccagaagcttggcttcgcagtgagcgatgtgcattttgttgggcagtggcctgtggaaattggattccccccttcagcagtatgttggtctgagaaccatattggttaagttgttattttaactgtgctttaacagacaactggaactgattgtttggtatgaatttctagcacctctaaaagtacttaggggcttttttttttctggatggttaagtgtattaaatatccctcattgtcttaattatcttgctagataggcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttt

SEQ ID NO: 686 - DNA, 581 bp, Homo sapiens
atgcgcactcggtcaaacccggcctggggaaatttcctatcgcacgtctgctgcagcagtctcctgtttctcctcctaccttctccatttttctagtccctgcagggcctcggcttccctcacgatattgcagaaagacacagctttcctcttcctctccaaaccacctcgaagcaggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttt

SEQ ID NO: 687 - DNA, 540 bp, Homo sapiens
gacgcgaggaggggagcagagaacgcgctcgcgtagaggaattccgggtcctcctcctcgccctaccttggtttacctgcagccgcctagtcctcttctccttctctttgatgattcagggcctcggcttccctcacgatattgcagaaagacacagctttcctcttcctctccaaaccacctcgaagcagggttaaggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattg

SEQ ID NO: 688 - DNA, 580 bp, Homo sapiens
cctatcgcacgtctgctgcagcagtctcctgtttctcctcctaccttctccatttttctagtccctgcagatggtaattatatttttcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagat

SEQ ID NO: 689 - DNA, 599 bp, Homo sapiens
ctatcgcacgtctgctgcagcagtctcctgtttctcctcctaccttctccatttttctagtccctgcagccccacccccaggaccagcctgagtggctgcgctcaccacgacgaggaccgcggcgtgttcgccccccaacagacggagccagcggcgaaggcggcgtgcgcgcgcccgtgccgtggtgggcgtggccggggcggagacgcgaggaggggagcagagaacgcgctcgcgtagaggaattccgggtcctcctcctcgccctaccttggtttacctgcagccgcctagtcctcttctccttctctttgatgattcagggcctcggcttccctcacgatattgcagaaagacacagctttcctcttcctctccaaaccacctcgaagcaggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccac

SEQ ID NO: 690 - DNA, 1501 bp, Homo sapiens; identical to SEQ ID NO: 678

SEQ ID NO: 691 - DNA, 2793 bp, Homo sapiens
agtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaacga

SEQ ID NO: 692 - DNA, 2823 bp, Homo sapiens
gcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaag

SEQ ID NO: 693 - DNA, 873 bp, Homo sapiens
gccacctcgtgtatgcagagaccatgtgtgtctgatctgctgggatcctagagctggaacaggccaagtgatattgtgaaaagaacactggacagcaagacaggagaccttggatctgccactcactgactgtgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctg

SEQ ID NO: 694 - DNA, 2291 bp, Homo sapiens
agtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaaatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccct

SEQ ID NO: 695 - DNA, 852 bp, Homo sapiens
gtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagttggaactgataatgggagagaagcaattgaaagtggggctgcatttctcttcatgacatttcacttgaaggactctgttggtcacaaggaaacaaaggctatcaaacagatgtttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttgg

SEQ ID NO: 696 - DNA, 3433 bp, Homo sapiens
gggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagaagtgaattgtccattccagaagaggaggctggatggaaaagaggaggatgagaagatgagcagagcttctgacagattcagaggactaagatgacaaaaatgactaaaatggacaaaagaagaaatagaaaatctgaatatttgactattaaaggaatttaatctgtaattaaaaaccttaagtacaaagaaatctatatgctatgatggctttaatggagaatgtcataatgtcatttaaaaaggtatgagagtactattgtagattaaaagaggttaaaggcatataataatcaaaatgtaatgtatgatccttgattgactcttgaatcagaaaaaaattacgtatttttggggccgttggagaaatctgaatatgggctggacatcattaggtaatattagatctcaggtgtgataatgttgtggctatgtaagaggatatcctaaatctcaggagaagcatactgcagtatatatagtggtatctcatgaagattaaaatgtactgtcaaatgtgtcagcaaaagaaatacacatgatgtgtgtgtgtgatcaagtgtttataatgagtggattaataaatatgagaagatagggtgatttgttgtaaagtaataaaggtttaaaaattacatgattcagtagagaaaaagcattttatgaatatctaacattacttatgataaaaaatctcagcaaactaggaatagaaggggattttgttaatctgataagctgtagctataaaaaacttggagaaaacatacttaatgctacaaagttagaagcttccctgaggtacggaattagacacaaatgcctgttaccacttctgtttctcactgtattaaaaatccttgctaacataatatggcaagaaaaagtaagggcataaagactggaaaaaaaaacttttccatttttcacatgactgtacctgtagaaaatgaatttaacaaggttaatataaaaatcaattttatttctacttactagaagcacattaaaaattacacttatctttatgtaacgtaatacattttaccttaaattttaaaattttaatttattttacgtttacaaaagcatcataaacatcaaatacgtaggagtaaatttaacaaaaaataagcaagacttcatggaaaactaaaatattgagagaatttaaagaagatctaaataaacagagggatataccaagaattggaagactcactattataatgatatattttttacccaaattgatctgtagattcagtgctatcccaggcacagtcttatgtttgagggtgtgtgtgtgtgtgtgtgtgtatgtgtgcatgtgtgtgtgtggaaattgacaagggtaatatgaaagttatatggaaattcaaaggcaaagagcagcctggttaactttgaaaaataaaaagggagaacttactctagtagatcttaaaacttattataaagataagtatacagtgtggtgttggtccaagaataggcaaatggactagtatgacagaatatagcccagaaacaaacctacggatagaaatatacttgatttataatgaaggccaaacaatagtgagacaaggctattttttcagtatatggtgctgggtcaactgcatatacagatgaaaaaaagtacctattttacaaataattttaaacagcctacagaattaagcatgatacacaaaacaatacatcttctaaaagatgtaaaagagtgtcttcaggatctttgtatgtgcgaaaatttatcaaacagagaacaaaaagtacaaagggaatgattaagttggactgtagtaaaattaataccttctatttattaagagtaaaaaggcaaaacatggagtgggagaatatagcttcaagatatataaccaaaaagagagcttttatccaggttaaatacgagctcctacaaatcaataaggaaaggacagataatcctatatgaacatgagtaagagctttgaacaaggacttcacaagagatagttgaccagtaaacatgaaaagggcttcagcttcattggtagtcaaggatatgccactgcatgcccattagaatggttaaaatgtaaaagactgacatacctattgttaggatcaagaatgtgaactagaatttttgtctactgctgctagagtttacaattggtacaaccactttgagtaactgtttgacagtgtctactattacctactgtggttggacaagtgaaattttaaatcttaggacataaatatccaataaaaatgcttgtacatacatgtatatcaaaaataggtgcattcattgcaacattatttgtgatagccttaatgtagaaacaacccagttcattgttaaaaagcttaagttgtagtatgtagactgccttatagcagtaacggattacagctatgtataacattgtaagtgaatcttataatgttgacaaaagaagccatacaacacatattatgattccattaatatgaaactgaaaactaggcatgaccagtctctggttttagaagtcaggatagtggctgcttttgaggaaggaggtagtgactaggagtgaatatgagggaggtttctggggagctgataatgttctgattcttgaagtagttaaccagattacacaggtgtgttcgttttttgataattctttgaactgtatgtgtactgtatattttcttgttatattcaataaaaagaattactatgatttttatattacatagattaaataagaagtatttcagattgataagtaacacatgcttgtgtatttatttagcttaaggtttggctatcatggtgagaactcctatgtaccctgctcaggtcctggtaaacagtatcataagtataataaattggtgtttttcattctca

SEQ ID NO: 697 - DNA, 8146 bp, Homo sapiens
agcggggcggtgacgtgtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagttggaactgataatgggagagaagcaattgaaagtggggctgcatttctcttcatgacatttcacttgaaggactctgttggtcacaaggaaacaaaggctatcaaacagatgtttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttggaccactttgacgaactgccaataaatggtgaaactcagaaaactataagcctagattataagaagtttctgaatgaacatctccaggaggcttgcaccccagaactcaagcctgtggaaaaaacaaatggctcctttttgtggtgtgaagttgaaaagtacctaaattcaactttgaaggaaatgactgaagtgccaagagtagaagatctttgctgtactttatatgatatgcttgcttctattaaaagtggtgatgaacttcaggatgagctatttgaactgctgggacctgaaggacttgaacttattgagaaactcctccagaacagaattacaattgtggatagatttcttaattcttcaaatgatcataggtttcaggctcttcaagacaattgtaaaaaaattttaggagaaaatgctaaacccaattatggttgtcaagtcactattcagtctgaacaagaaaagcagttaatgaaacaatatcgacgtgaagaaaaaagaattgccagacgagaaaaaaaggctggagaagatttagaagtttcagaaggacttatgtgctttgatcctaaggaattgcggatacaaagagaacaggcacttctgaatgctagaagtgttccaattctgagcaggcagagagatgcagacgttgaaaaaatacattatccccatgtgtatgattcccaggctgaagccatgaaaacatcagcatttattgctggtgcaaagatgattttgccagaaggaatccaaagagagaataacaagctttatgaagaagtaaggattccctacagcgaaccaatgccactcagctttgaggaaaagccagtttatatccaagacttagatgagatcggacagctggcttttaaaggaatgaagagactcaatagaatccagtcaatagtgtttgagactgcctacaacaccaatgagaacatgctgatttgtgcccctacaggagctggaaaaaccaacattgcaatgctgacagtcttgcatgaaattcgccaacattttcaacaaggtgttatcaaaaagaatgaatttaagattgtatatgttgctccaatgaaagccttggcagctgaaatgacagattacttcagcagacgtctagagccactaggcatcattgtgaaagaattgactggtgacatgcagttgtccaaaagtgaaattttacgaactcagatgcttgtgaccacaccagaaaaatgggatgtagtgacaagaaagagtgttggggatgtagctctttcccagattgtaaggctccttattcttgatgaagttcatttgctgcatgaagatagaggaccagtattagaaagcatagttgcccgtactttacggcaggtggaatccacacagagtatgataaggattctcggactgtctgcaactttacctaactacctcgatgttgccacatttttacatgttaatccatacattggacttttcttctttgatggccgttttcgaccagtacctcttggacagacatttttggggattaaatgtgcaaataagatgcagcagttgaataacatggatgaagtatgttatgaaaatgttttgaagcaagtaaaggctggacaccaggtgatggtgtttgtacatgctcgaaatgccactgtaagaacagctatgtctctaatagaaagagcaaaaaattgtggccatattcccttcttttttcctacccaaggacatgactatgtacttgcagaaaaacaggtacaaaggtcgagaaataagcaagtacgagaattattcccagatggttttagtattcatcatgcaggaatgcttcggcaggacagaaatttagttgaaaacttgttttctaatgggcatatcaaagtcctagtgtgtacagctacgttagcctggggtgtcaatcttcccgcccatgctgttattattaagggaacacaaatatatgctgcaaaaagaggctcctttgttgaccttggaattttagatgtcatgcagatatttggtcgagctggacgaccacaatttgacaaatttggggaaggaataattataacaacgcatgataaactcagccattacctcactttgctcactcaacgaaacccaattgagagtcagtttctggaaagccttgcagataacctaaatgcagagattgctctgggaacagttactaatgtggaagaagcagtgaagtggataagttacacttatctttatgtacggatgagagcaaatccattagcatatggcatcagtcacaaggcttatcagattgacccaacattaagaaagcatcgagaacagttggtcattgaagttggacgaaaactagacaaagctcagatgattcgttttgaggagcgaactggatatttttcctcaactgatttgggtagaactgccagccattactatattaaatacaacaccattgagacctttaatgaactctttgatgctcacaaaacagaaggtgatatctttgccatagtctccaaagctgaagaatttgatcaaattaaggtcagagaagaggaaatagaggagttagataccttattaagcaatttttgtgaactctccactcctggaggtgtagagaatagttatgggaaaataaacatcttacttcaaacttatatcagccgaggagaaatggacagtttctcccttatatcagattctgcatatgttgcacagaatgcagctagaattgtccgtgctctttttgaaattgctctgaggaaacgttggcctaccatgacctacaggctcctgaatcttagtaaagtcattgacaagaggctttggggttgggctagccctttgagacaattttcaatcctaccaccacacatcctaacaagattagaagaaaaaaagcttactgtggataagctgaaagacatgaggaaagatgaaataggtcacattttacatcatgtgaatattggactgaaggtcaaacaatgtgttcatcagattccttctgttatgatggaagcatccattcagcctatcacaaggactgtcctccgagtgacactcagcatctatgctgatttcacttggaatgatcaggtacatgggacagtaggagaaccttggtggatttgggtagaagatcctacaaatgatcatatttatcattcagagtattttctagctctaaaaaaacaagtcattagtaaagaagcccaactactggtatttacaatccctatttttgagcctttgccttcccaatactacatccgagcagtgtctgatagatggttgggtgctgaggcagtatgtattatcaactttcaacatctaattctaccagagagacatcctcctcatacagaattactggatcttcagcctttaccaatcacagctttgggatgtaaagcatatgaagccctgtacaacttcagccactttaaccctgtacagacacaaatatttcatacattgtatcacacggattgtaatgtcctacttggagcacctactggatcgggaaagactgttgcagctgaattagccattttcagagtcttcaacaaataccctacttcaaaggcggtatatattgcacccctaaaagccctagtacgtgaaagaatggatgattggaaagttagaatagaagaaaaacttggtaaaaaagttattgaactaacaggggatgtgactcctgatatgaaatccattgccaaggctgaccttatcgtcactacgccagagaagtgggatggagtcagcagaagctggcaaaataggaactatgttcagcaagtcactattctcatcatagatgagatccatctgcttggggaggaaagaggccctgttctagaggtcattgtatctcgaacaaattttatctcatcacacacagaaaagcctgttagaatagttggactatctactgcattagctaatgccagagaccttgctgattggctcaatattaagcagatgggcttgtttaacttccgaccatcagtacgcccagttccactggaagttcacattcaaggctttccaggtcaacattactgtcctcgtatggctagtatgaacaagcctgcatttcaggcaattagaagccattctccagccaaacctgttttgatatttgtctcatcaagacgtcaaactcgtcttactgctttggaattgatcgccttcctggctactgaagaagatccaaagcagtggttaaacatggatgaaagagagatggagaacatcattgcaacagtaagagattccaacctcaagctgacccttgctttcgggataggaatgcatcatgctggactacatgagagggaccgaaaaacagtagaggaactatttgtaaactgtaaagttcaggttcttattgctacaagcacattagcctggggtgtaaactttccagctcatttagtaattattaagggaacagaatactatgatggaaaaacaagacgttatgtggattttcccattacagatgtcctccagatgatggggcgtgctgggaggccgcagttcgatgaccaaggcaaagctgtaattctagttcatgacataaagaaagacttttataaaaaatttctttatgaacctttcccagtagaatcaagtttattaggagtgctctctgaccacttaaatgcagagattgctggtggtacaattacatctaagcaagatgcattggattatatcacctggacttactttttccgacgtcttatcatgaatcccagctattacaatttgggtgatgtgagccatgattctgtgaacaagtttctgtcccatctgattgagaagtccctgattgaattggaactttcctactgtattgaaattggagaggataatcgcagcattgaacctctaacttatggccgaattgcctcctattactatttgaagcatcaaacagttaaaatgttcaaggaccgcttgaagcctgaatgcagtactgaagaactgctttcaattctaagtgatgcagaagaatatacagatttgccagtgagacacaatgaagatcatatgaatagtgaactggcaaaatgtcttcccattgaatcaaatcctcattcatttgacagccctcacaccaaagcacatctcctgctacaggcacatctcagccgagccatgctaccctgcccagattatgacactgataccaaaacagtcttggaccaagctctcagagtatgtcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagaaatggaagccgattatgaagggcccacatgctaggggtcggacctccatcgagtcccttcctgaactgatccatgcctgtggagggaaagaccatgtatttagctccatggtagaaagtgagctacatgctgcaaaaacgaaacaggcatggaatttcttatctcacttgccagtgataaatgttggcataagtgttaaaggctcgtgggatgacttagttgaaggacataatgaactctctgtctcaactctgactgcagacaaacgagatgacaacaaatggatcaaattgcatgctgaccaagagtatgtgcttcaagtgagcttgcagagagtccactttgggttccacaagggaaagccagagagctgtgcagttactcctcgatttcccaaatcaaaagacgaaggatggtttttgatattaggagaagtggataagagagaacttattgctttgaaaagagtaggatatattcgaaatcatcatgttgcttccctttctttttatacccctgaaatacctggaaggtatatctacacattatatttcatgagtgactgctaccttggcctggaccagcagtatgacatctatctcaacgttacacaagcgagtctttctgcacaggtcaacaccaaggtctctgattccctgactgacctggcattaaagtaacttgacctgaacaatccatttgaaaggagtggctaagaattctctctgttcagtcatctagacaaatcgaattacttgatgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataaatctgtaaggtggtacacagcgtgtcttgttagcaaaatttatactttgatatgatcacatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaagacaagctgactcaatgttttcttctgcttcctttaaataatatccccttactcatctgttcttcttttctttcccttctacttcaaggctttatttctattatctttctgacatatttatttacagaagtagagaagtataatctaattcatgttgtagcacttacagatcatatagtacaattatttgtctttatgctctccaggaaaaatctgagacagaaaatttttcacccctatggataggttttcacctgtaataaagaaaatttctctatgtccaaacaaattccttcttgaaaaatactttttcaaactaaaaacttgttaaaattcaatgttcatataatatgcattctagtggaatgaaattctacctttgtgaaataatttcagttttcttagccctaaaatgaattattttaaaacattttccaatgtcattgttacaaatactagaatttaagtgtttctgaaattggaatgtattgcttgtatatatccttttccatgcttaaataaaaaagaagaagaaataaa

SEQ ID NO: 698 - DNA, 2181 bp, Homo sapiens
gaggcggcagccacagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtacattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgtttaaaagtttgatacttttaaatagttggtttttttgcttactctggtaatgattttctacaaatacataataaattgtttttttgagtctatattctgtatgcagttgaatatccattacttattctgctgtgctttaatagaatggaatgtttacaggcccttaaaatattatttttaaaaaaccttctgaagatacataccaaagtttttccaagaagattttataatcaatttaataatgtaaggtttatcagattctataatagtatagttattaaggcaattttatgttagagactattttgtaatgtagtgagtggtacctttataagaaaagtgactgccaatatatttttatagctgatctttataaattctaatgttgagtttttaatgattattttaaatgtttatatagtttagtaaaatttgcatctcaaagtatcatttttatattatgggacgttttcagattggctaatatttgcattgtaaattttgtatgcagtttatctaaaattcaaaaatactgtcagtacaccagcgtttaacatctatattccaatttgtatacagtttaaaattgtactgcaaaactattgtgtgctcttacacagtatgcatcatattgttgtctgtgaaattaaaggacatttgatagtc

SEQ ID NO: 699 - DNA, 970 bp, Homo sapiens
tccgcgcctcggtgcagagctgcgctgcgcccttccagtcgtgcgtctcctcctttccctcgcccccaaataaaaagacgaggtcttgctacattgtccaggatggagaagtaggaattcttaaggatattgttatggagggaaaaaaatcattgattatggaagattcccacaagagtaccacgtcagagacagcacctcaacctggttcagcagttcagggagctcacatttctcatattgctcaacagttgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagc

SEQ ID NO: 700 - DNA, 745 bp, Homo sapiens
cccttccagtcgtgcgtctcctcctttccctcgcccccaaataaaagtaaagcccgaaaccgcccgccgcggggtggctttcgcctcagaagccgccctttgcagtcgcaggcgctagctctccgtgggaggtctcgagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtacattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtg

SEQ ID NO: 701 - DNA, 549 bp, Homo sapiens
cagggccggcgtcggtcaaggtcaattggcagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtacattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaa

SEQ ID NO: 702 - DNA, 482 bp, Homo sapiens
atgatgcttcaacacccaggccaggtctctgcctcggaagaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccag

SEQ ID NO: 703 - DNA, 2033 bp, Homo sapiens
attacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaaca

SEQ ID NO: 704 - DNA, 680 bp, Homo sapiens
ggcggaggtggggttagcttcagttgaccaaccatgccttgaggataaattggatgggatcagatgggaagatgtgacaagaagagaaatcctcctctatataggatgctctgctgtttcctaaggattttcagcaccttgccccaaaatcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaag

SEQ ID NO: 705 - DNA, 858 bp, Homo sapiens
atgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaa

SEQ ID NO: 706 - DNA, 516 bp, Homo sapiens
cgagcggagcctggagcaaaatgatgcttcaacacccaggccagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttataccc

SEQ ID NO: 707 - DNA, 1896 bp, Homo sapiens
agttgaccaaccatgccttgaggataaattggatgggatcagatgggaagatgtgacaagaagagaaatcctcctctatataggatgctctgctgtttcctaaggattttcagcaccttgccccaaaatcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggt

SEQ ID NO: 708 - DNA, 767 bp, Homo sapiens
atgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaa

SEQ ID NO: 709 - DNA, 2019 bp, Homo sapiens
tttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgccctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 710 - DNA, 1420 bp, Homo sapiens
tttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagta

SEQ ID NO: 711 - DNA, 1910 bp, Homo sapiens
aggtggacaggcccggcgcgccctctcgaggccccttcaacctcccgggggcagcagcgccgtgtcggctatgaatggggcctctggaaaactcaggcttggaacagcacctcgcgcgataacctggcgtcctcggccttcacaataaaaactcttcgccggaaaacgacctttccccgcccactgcgctgacaccggaagcgaggcgtgtctgggagatcactccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggccacggcagccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 712 - DNA, 2259 bp, Homo sapiens
gtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccttaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 713 - DNA, 7496 bp, Homo sapiens
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggtggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaacgcagattagtgaacgtggattcctgctgagggagtgcatcccataatatggcaataattttcagtttctccaacgaaaagatagtgaaggaattaaatcttttgtcctcccatggttaaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactccccttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttgccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaaatgaggggacaggattctcctaagggtagagtttcaggaaatgagtgaaaggcaattgacaaatgcaaagaagtagtcactttttaaattgctggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctcttggggctgacaataatacactcttgggaagtgatggtagagactgatgggaatagtctttctgcctggttgcaagtcccaaatttttaagggttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaaatctgctgtttgccatgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaaacttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcggccatttgttctaatatgtgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactttcaagcaagtctttatactacctgttatttctctaaaattcaaataaagaatttttaaactta

SEQ ID NO: 714 - DNA, 2620 bp, Homo sapiens
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcccggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 715 - DNA, 771 bp, Homo sapiens
aaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaaggaccacctgctgctcccagccatcagccacaacaagacctcccggcccaagatgtccctggtgatgcctgccatggcccccaatgcctcctgaatgatgccagcccagtatgctctaacctccagcctggttctcctggtgctgctgagcacagccagagca

SEQ ID NO: 716 - DNA, 2624 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 717 - DNA, 2620 bp, Homo sapiens
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 718 - DNA, 2624 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcccggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 719 - DNA, 425 bp, Homo sapiens
ccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagtccttagatacttctccttccagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccg

SEQ ID NO: 720 - DNA, 425 bp, Homo sapiens; identical to SEQ ID NO: 719

SEQ ID NO: 721 - DNA, 2620 bp, Homo sapiens
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtggaacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 722 - DNA, 2620 bp, Homo sapiens
aaccgtctcctggttgtggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 723 - DNA, 2624 bp, Homo sapiens
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtggaacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 724 - DNA, 425 bp, Homo sapiens; identical to SEQ ID NO: 719

SEQ ID NO: 725 - DNA, 2624 bp, Homo sapiens
ggcgggccttgggaaccgtctcctggttgtggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 726 - DNA, 425 bp, Homo sapiens; identical to SEQ ID NO: 719

SEQ ID NO: 727 - DNA, 771 bp, Homo sapiens; identical to SEQ ID NO: 715

SEQ ID NO: 728 - DNA, 771 bp, Homo sapiens; identical to SEQ ID NO: 715

SEQ ID NO: 729 - DNA, 771 bp, Homo sapiens; identical to SEQ ID NO: 715

SEQ ID NO: 730 - DNA, 6158 bp, Homo sapiens
atgacttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaagtcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattgcctttccgtatgaaacccttccagttgtcccagagccactttctgccatctgtgcaagccaagaatgtccttctctccatctttcctacctccatcttaaacatacatacaaaataactgccagcttcctttcttattttgtctccaaaattgactgtcacaggggaatgagaaaatgttctaagctacaagattcccgtttccttaaagtgatatcctgtcctagtgaaccagtcaggtaacaggttctgctgcatttgttttaaatttcccctcctgcttttcagagctggtgctgaacaggccacacccctaaagacaaaggagagaaaacacggttttctcatcctctaccatcaggtacccaacaggaataggccctgaagtgattcagactagcaaatgttatggcagatggtcaggacgcaggttaccacatccagggacttcacttttgcctttaaaaattcacagccgtaacttgtgctcaggacttcccctttagctggctgctccctgggattttctcctgctttagagttttgtttcatttttttattgtcttgatttcccagtagcagccttgccctaaagcttgactgagtttatggctcctaaggagctttcctaagactcttgactatttttcttcccccttcagtcaagtgtttttacagttaagaattaatttgtaactgcatacatgccctgccagtctgtccctgtgttgggtggctaatttatgtagcgggtcttttttatttcttagcccccatgactaattatctagtcctaacttcatttttatcagtgggaagatgtgtacgggacctcagtgaggagcactgccagaaccacagtaacaaaatggcactgaaataaggaagcagcaggtcagaaccccctagatagttcttgagttggttctcagtctcactaaggaggcagaataattgctgccctgaaacttctctgatagtcaaaggtaacttcacttaccttgttattgctaccagccatgtggtcactctccccaaatctttgtcttccagatccatctggaccagaaccaaacatcatggaaggtgtcacttggcccttcctaaagtccatggcgtttctagaggcctaagggaggacactttcagaaaggagctgagtgtatggtgggtgtcctgaattcgttcatgtgaatacaggactcaggcttcccaccccactccaatgtgagtgctcgatacacaagcactctagctagctgccacgtacccaaggccacagagggaggggacagaaccaggtcttctggtctgctcactttctgccccattcccctaacagaaagtttgcttagagttgaaaagtctaagaaagcctcccacaatactagagaggccaacaaaaaaaaagtcatgccccctttacttactcttttgctgctggttatgcatctcaaatctgacttccttagccttcacctccctccttggccctaagcattagaccatgtactctaagtagtggttaaagagggactgagcaaactgaacctcctctcgctcacttctctatccctgttctgttggttttggctcctttcttgattcactgccctctagcaccacccatcctggtagatggagtgcttaaccccaaccgtgccctatgtacagcctgaaccaccaaacagacaccaaaaaaattcttcctgtggtttctggggctcccctgctccacactgagaggctccttaaaggtgctagcccctgatacagctatccccgccagttttctccttttttcataacttccttcccatccccaaatcattaatttttcattaatattgtacattatatacacaggaaggaaatacattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataagctgggaaatttttacaggtgtggaggatatttcaaatacatcttttgcctttgcactaacatgctttcatttctttcagtctcttcctccattccctttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtg

SEQ ID NO: 731 - DNA, 6582 bp, Homo sapiens
ctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattgcctttccgtatgaaacccttccagttgtcccagagccactttctgccatctgtgcaagccaagaatgtccttctctccatctttcctacctccatcttaaacatacatacaaaataactgccagcttcctttcttattttgtctccaaaattgactgtcacaggggaatgagaaaatgttctaagctacaagattcccgtttccttaaagtgatatcctgtcctagtgaaccagtcaggtaacaggttctgctgcatttgttttaaatttcccctcctgcttttcagagctggtgctgaacaggccacacccctaaagacaaaggagagaaaacacggttttctcatcctctaccatcaggtacccaacaggaataggccctgaagtgattcagactagcaaatgttatggcagatggtcaggacgcaggttaccacatccagggacttcacttttgcctttaaaaattcacagccgtaacttgtgctcaggacttcccctttagctggctgctccctgggattttctcctgctttagagttttgtttcatttttttattgtcttgatttcccagtagcagccttgccctaaagcttgactgagtttatggctcctaaggagctttcctaagactcttgactatttttcttcccccttcagtcaagtgtttttacagttaagaattaatttgtaactgcatacatgccctgccagtctgtccctgtgttgggtggctaatttatgtagcgggtcttttttatttcttagcccccatgactaattatctagtcctaacttcatttttatcagtgggaagatgtgtacgggacctcagtgaggagcactgccagaaccacagtaacaaaatggcactgaaataaggaagcagcaggtcagaaccccctagatagttcttgagttggttctcagtctcactaaggaggcagaataattgctgccctgaaacttctctgatagtcaaaggtaacttcacttaccttgttattgctaccagccatgtggtcactctccccaaatctttgtcttccagatccatctggaccagaaccaaacatcatggaaggtgtcacttggcccttcctaaagtccatggcgtttctagaggcctaagggaggacactttcagaaaggagctgagtgtatggtgggtgtcctgaattcgttcatgtgaatacaggactcaggcttcccaccccactccaatgtgagtgctcgatacacaagcactctagctagctgccacgtacccaaggccacagagggaggggacagaaccaggtcttctggtctgctcactttctgccccattcccctaacagaaagtttgcttagagttgaaaagtctaagaaagcctcccacaatactagagaggccaacaaaaaaaaagtcatgccccctttacttactcttttgctgctggttatgcatctcaaatctgacttccttagccttcacctccctccttggccctaagcattagaccatgtactctaagtagtggttaaagagggactgagcaaactgaacctcctctcgctcacttctctatccctgttctgttggttttggctcctttcttgattcactgccctctagcaccacccatcctggtagatggagtgcttaaccccaaccgtgccctatgtacagcctgaaccaccaaacagacaccaaaaaaattcttcctgtggtttctggggctcccctgctccacactgagaggctccttaaaggtgctagcccctgatacagctatccccgccagttttctccttttttcataacttccttcccatccccaaatcattaatttttcattaatattgtacattatatacacaggaaggaaatacattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataagctgggaaatttttacaggtgtggaggatatttcaaatacatcttttgcctttgcactaacatgctttcatttctttcagtctcttcctccattccctttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtg

SEQ ID NO: 732 - DNA, 6623 bp, Homo sapiens
atgacttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattgcctttccgtatgaaacccttccagttgtcccagagccactttctgccatctgtgcaagccaagaatgtccttctctccatctttcctacctccatcttaaacatacatacaaaataactgccagcttcctttcttattttgtctccaaaattgactgtcacaggggaatgagaaaatgttctaagctacaagattcccgtttccttaaagtgatatcctgtcctagtgaaccagtcaggtaacaggttctgctgcatttgttttaaatttcccctcctgcttttcagagctggtgctgaacaggccacacccctaaagacaaaggagagaaaacacggttttctcatcctctaccatcaggtacccaacaggaataggccctgaagtgattcagactagcaaatgttatggcagatggtcaggacgcaggttaccacatccagggacttcacttttgcctttaaaaattcacagccgtaacttgtgctcaggacttcccctttagctggctgctccctgggattttctcctgctttagagttttgtttcatttttttattgtcttgatttcccagtagcagccttgccctaaagcttgactgagtttatggctcctaaggagctttcctaagactcttgactatttttcttcccccttcagtcaagtgtttttacagttaagaattaatttgtaactgcatacatgccctgccagtctgtccctgtgttgggtggctaatttatgtagcgggtcttttttatttcttagcccccatgactaattatctagtcctaacttcatttttatcagtgggaagatgtgtacgggacctcagtgaggagcactgccagaaccacagtaacaaaatggcactgaaataaggaagcagcaggtcagaaccccctagatagttcttgagttggttctcagtctcactaaggaggcagaataattgctgccctgaaacttctctgatagtcaaaggtaacttcacttaccttgttattgctaccagccatgtggtcactctccccaaatctttgtcttccagatccatctggaccagaaccaaacatcatggaaggtgtcacttggcccttcctaaagtccatggcgtttctagaggcctaagggaggacactttcagaaaggagctgagtgtatggtgggtgtcctgaattcgttcatgtgaatacaggactcaggcttcccaccccactccaatgtgagtgctcgatacacaagcactctagctagctgccacgtacccaaggccacagagggaggggacagaaccaggtcttctggtctgctcactttctgccccattcccctaacagaaagtttgcttagagttgaaaagtctaagaaagcctcccacaatactagagaggccaacaaaaaaaaagtcatgccccctttacttactcttttgctgctggttatgcatctcaaatctgacttccttagccttcacctccctccttggccctaagcattagaccatgtactctaagtagtggttaaagagggactgagcaaactgaacctcctctcgctcacttctctatccctgttctgttggttttggctcctttcttgattcactgccctctagcaccacccatcctggtagatggagtgcttaaccccaaccgtgccctatgtacagcctgaaccaccaaacagacaccaaaaaaattcttcctgtggtttctggggctcccctgctccacactgagaggctccttaaaggtgctagcccctgatacagctatccccgccagttttctccttttttcataacttccttcccatccccaaatcattaatttttcattaatattgtacattatatacacaggaaggaaatacattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataagctgggaaatttttacaggtgtggaggatatttcaaatacatcttttgcctttgcactaacatgctttcatttctttcagtctcttcctccattccctttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtg

SEQ ID NO: 733 - DNA, 6686 bp, Homo sapiens
atgacttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattgcctttccgtatgaaacccttccagttgtcccagagccactttctgccatctgtgcaagccaagaatgtccttctctccatctttcctacctccatcttaaacatacatacaaaataactgccagcttcctttcttattttgtctccaaaattgactgtcacaggggaatgagaaaatgttctaagctacaagattcccgtttccttaaagtgatatcctgtcctagtgaaccagtcaggtaacaggttctgctgcatttgttttaaatttcccctcctgcttttcagagctggtgctgaacaggccacacccctaaagacaaaggagagaaaacacggttttctcatcctctaccatcaggtacccaacaggaataggccctgaagtgattcagactagcaaatgttatggcagatggtcaggacgcaggttaccacatccagggacttcacttttgcctttaaaaattcacagccgtaacttgtgctcaggacttcccctttagctggctgctccctgggattttctcctgctttagagttttgtttcatttttttattgtcttgatttcccagtagcagccttgccctaaagcttgactgagtttatggctcctaaggagctttcctaagactcttgactatttttcttcccccttcagtcaagtgtttttacagttaagaattaatttgtaactgcatacatgccctgccagtctgtccctgtgttgggtggctaatttatgtagcgggtcttttttatttcttagcccccatgactaattatctagtcctaacttcatttttatcagtgggaagatgtgtacgggacctcagtgaggagcactgccagaaccacagtaacaaaatggcactgaaataaggaagcagcaggtcagaaccccctagatagttcttgagttggttctcagtctcactaaggaggcagaataattgctgccctgaaacttctctgatagtcaaaggtaacttcacttaccttgttattgctaccagccatgtggtcactctccccaaatctttgtcttccagatccatctggaccagaaccaaacatcatggaaggtgtcacttggcccttcctaaagtccatggcgtttctagaggcctaagggaggacactttcagaaaggagctgagtgtatggtgggtgtcctgaattcgttcatgtgaatacaggactcaggcttcccaccccactccaatgtgagtgctcgatacacaagcactctagctagctgccacgtacccaaggccacagagggaggggacagaaccaggtcttctggtctgctcactttctgccccattcccctaacagaaagtttgcttagagttgaaaagtctaagaaagcctcccacaatactagagaggccaacaaaaaaaaagtcatgccccctttacttactcttttgctgctggttatgcatctcaaatctgacttccttagccttcacctccctccttggccctaagcattagaccatgtactctaagtagtggttaaagagggactgagcaaactgaacctcctctcgctcacttctctatccctgttctgttggttttggctcctttcttgattcactgccctctagcaccacccatcctggtagatggagtgcttaaccccaaccgtgccctatgtacagcctgaaccaccaaacagacaccaaaaaaattcttcctgtggtttctggggctcccctgctccacactgagaggctccttaaaggtgctagcccctgatacagctatccccgccagttttctccttttttcataacttccttcccatccccaaatcattaatttttcattaatattgtacattatatacacaggaaggaaatacattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataagctgggaaatttttacaggtgtggaggatatttcaaatacatcttttgcctttgcactaacatgctttcatttctttcagtctcttcctccattccctttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtg

SEQ ID NO: 734 - DNA, 2634 bp, Homo sapiens
gctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccc

SEQ ID NO: 735 - DNA, 1801 bp, Homo sapiens
gctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgcaaatctgagtagcctccaagaggcacacaagcagaggatgggctgtgttgccctgactgccagccccaggcacagaggaccaggcctggtcatcctcacagactctgaccctggctcttcccactcctcttccactccaggacatcctacttaacccctcctgacatgag

SEQ ID NO: 736 - DNA, 774 bp, Homo sapiens
ggggggaaggcggggccagaggcttgaagtgtggggagaacttggtctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggtattcagacctaggctatttttattgtgctttgggataattttcttaattggttaaaacacaaaatcatgggcttagtagagtaaaaccagtaaaaccagatagtagtcactaatcccagtcagccattcaggtctttaggagttccagatgatggatcagcacaagtctgtcgtcaccgaaaattagtcctcttgttcttccaggggagtattagtttaataatcggttttttaaaaaatatttatattataaatatgttgaagatgttaaaaggtgataaattactcagattttgttggataacatatttgttgccaaattccactcttttctgagctgatcagacttctcagctacactgtttttttgaatcagcaagtcaataaacatttatcaaatttccactc

SEQ ID NO: 737 - DNA, 860 bp, Homo sapiens
ttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggtattcagacctaggctatttttattgtgctttgggataattttcttaattggttaaaacacaaaatcatgggcttagtagagtaaaaccagtaaaaccagatagtagtcactaatcccagtcagccattcaggtctttaggagttccagatgatggatcagcacaagtctgtcgtcaccgaaaattagtcctcttgttcttccaggggagtattagtttaataatcggttttttaaaaaatatttatattataaatatgttgaagatgttaaaaggtgataaattactcagattttgttggataacatatttgttgccaaattccactcttttctgagctgatcagacttctcagctacactgtttttttgaatcagcaagtcaataaacatttatcaaatttccactc

SEQ ID NO: 738 - DNA, 4656 bp, Homo sapiens
gaatctgcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccata

SEQ ID NO: 739 - DNA, 1727 bp, Homo sapiens
aaggtaaccaaaactaagaaattgatgttaggtaatttgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaa

SEQ ID NO: 740 - DNA, 555 bp, Homo sapiens
aggtgttggtattagtccctttttaagggaggacagactattacaagataaagctgtaattgataaagaagttggcctggtgtggtggctcacacctgtaatcccagcactttgggaggccgaggcaggtggatcacgaggtcagaagatcaagaccatcctggctaacacgattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgc

SEQ ID NO: 741 - DNA, 550 bp, Homo sapiens
ttcttctttttttctcaagagaatatttgacctgatgtaattcttggatctctgaggtcttctacacagaagtatatttagagagcaattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggt

SEQ ID NO: 742 - DNA, 572 bp, Homo sapiens
tttctcaagagaatatttgacctgatgtaattcttggatctctgaggtcttctacacagaagtatatttagagagcacctcattatgttgcccaggctggtcttgaactccaggggtcaagagagtttcccacttcagcctcccaaagtgctgagattacaagcatgagccaccatgtccagcctgtactgcctttcctttttcctttatgatttctacagcacttgtctgcccagaaaatattacctgttgtaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcag

SEQ ID NO: 743 - DNA, 571 bp, Homo sapiens
gatgttaggtaatttgcccagtctcacacagtaggtttcctgggagagttggaattcaaatctgtgaatctgtctacagtctacagagttcatgttcttaattgggttattaaaagtgatgaatttttttaaaggaatgcttacttttaatggaggacagactattacaagataaagctgtaattgataaagaagttggcctggtgtggtggctcacacctgtaatcccagcactttgggaggccgaggcaggtggatcacgaggtcagaagatcaagaccatcctggctaacacgattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaagg

SEQ ID NO: 744 - DNA, 573 bp, Homo sapiens
aaactaagagtatggctgcagcaagctccctcttggattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctgg

SEQ ID NO: 745 - DNA, 4142 bp, Homo sapiens
tagtatacaacaagcagtaggttttctatgtcttaaacattacatgaaatgtgctgcttgcatctcttctaagatcaatttgtattaagtctacaattaggtggcttctgtttcagttattaaactctctttctcttttttcttaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagct

SEQ ID NO: 746 - DNA, 570 bp, Homo sapiens
agtttctgttgctgtgaaagaactgataagatggctgcagggggctccctttgggattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctg

SEQ ID NO: 747 - DNA, 580 bp, Homo sapiens
agaatctcaagctgaattggcttccagcaagtaggctaggcttattattttatgcgcttcagccaaagaccagcaggaacacctttgtaattgaaaaagttaggtttactatttgctgcagggaggaaataatgttcactatggggaaactgtaaggcacatcaatcagtaagaggatgttagaaaaaacctagtataggatttgagtatagtataggttgggttattttggggagagattaaggaagtagatccttatcgtggattgggtgacatcagaaagtgggggcacttctattcttgggtatctcaataaattttatctatatagggaggacagactattacaagataaagctgtaattgataaagaagttggcctggtgtggtggctcacacctgtaatcccagcactttgggaggccgaggcaggtggatcacgaggtcagaagatcaagaccatcctggctaacacgattcagaatggacagtttagaagaacctcagaaaaaagtctttaaggctcgaaaaacgatgagagtgagtgatcgtcagcaacttgaagcagtgtacaaggtca

SEQ ID NO: 748 - DNA, 575 bp, Homo sapiens
aaccaaaactaagaaattgatgttagggaggacagactattacaagataaagctgtaattgataaagaagttggcctggtgtggtggctcacacctgtaatcccagcactttgggaggccgaggcaggtggatcacgaggtcagaagatcaagaccatcctggctaacacgattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtg

SEQ ID NO: 749 - DNA, 564 bp, Homo sapiens
aatgacgtcacatatgagatagaatggagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctct

SEQ ID NO: 750 - DNA, 574 bp, Homo sapiens
agacctaatagttggcagcatagaaagcagtacaaagaattctgattctaggcattttcactttgaaatagtcattttgaagatatactctgtgtgttctgtgagcttcattgacatattgtctgacgttttttggcttttgtggtaaatgggatgtatgctgcacaaactacccaacagatgtgaaccactatttgaaaggaattttaatatgtagccaacctactgtattcttgttttttttttaatgaatatgaatcaaacaagaaatttagactcgagaaggctgacctagaagtctgcattagcttttaatgtttatacaaatgaactaagtagcagtggtttacagaagaggaagtccttttcacagtgtcaagctgcccacagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttg

SEQ ID NO: 751 - DNA, 4324 bp, Homo sapiens
ggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtaagagatttttcttgtatatggccccaagatacatgtagttctcttcagcatttagttggaatggcatataataatgttaaattttgcaaaaatttcttataatgtcatattaaaagtattgttataagttcaagagatctgtactacaacatagaaactatagtatagttaaaatcaatgtagtatattcttgaaaatagctgatagagcagattttaagtattgtcaccacacacaaaaaaggtaagtatgtgagatcatgcatatgtcagctagatttagccattctgcagtgtatgcatatttcaaacatgttgtataccataaatatatataatttttgtcaattaaaaaatagttttcaaaaaagaaatggcagtataaccaaaactaatctattattatttttcttcccttaggagagttaaacagagaaaattgttgatgtatactagttgatttgtgctctgagtgttgtctttaatttaactttatttatggcctgtattagtatagtacacaatttgatattggtatattctctactctattaagaaacaccttacctagttagagtgggaatggtcaattgtgatttaccccagatgatggaaatcatggtaaaggatagccttcaatgagagtcttaaagatatggaaagtggctgagaaaagaagggaaaatgttaaagaaagcttgtagtttcttgtatatatcatatattagttacatacatatgttacatgcatgttacatatgtagatgacattttaaaattatatattaaccacatgtatataagcagtagtagaatatatcacataaacacaagcttatataaaaggtatatttaaactttaaagtaaagaaaaataataaaatgaactacgtatgaactctt

SEQ ID NO: 752 - DNA, 4847 bp, Homo sapiens
gacgggattcacaggcattatgttacaaaactggcttgctgccttctgttttctttttctgtgtcctgtgtagctgcattgtttgttgcagtatatgcattagctgttgtctatgttcagtttcctgcaggctgacaaagtgggaggggctttgtttgttacatagctgagttttcactgtgtgagttcttgagtgcacattgcagccatcttaattacacttttgtgcaactgagactgtgcagctgtctcaaaatggctgctaacctagtctttgtagctgcttaggcagcaagtatgtcagtgaggagacttgtcacatgcatcaggaccagagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccata

SEQ ID NO: 753 - DNA, 568 bp, Homo sapiens
atttagttctcatggcaacctttgtgacaggtgttggtattagtccctttttaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgc

SEQ ID NO: 754 - DNA, 3370 bp, Homo sapiens
atggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatgaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgc

SEQ ID NO: 755 - DNA, 3463 bp, Homo sapiens
atgtcttaaattccaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgc

SEQ ID NO: 756 - DNA, 3641 bp, Homo sapiens
agcattgttaacggctgcggttcgaagtggctgtgggtattgctgcggctggtgcgtcgtcgctctaggttttcttccgccgtctgtgacagcttcttgatctgtccccaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatgaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgca

SEQ ID NO: 757 - DNA, 3659 bp, Homo sapiens
gttaacggctgcggttcgaagtggctgtgggtattgctgcggctggtgcgtcgtcgctctaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgca

SEQ ID NO: 758 - DNA, 1907 bp, Homo sapiens
gttaacggctgcggttcgaagtggctgtgggtattgctgcggctggtgcgtcgtcgctctaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatgg

SEQ ID NO: 759 - DNA, 998 bp, Homo sapiens
ttgttaacggctgcggttcgaagtggctgtgggtattgctgcggctggtgcgtcgtcgctctagtaacaatgatgatgttatgttgatttctgtggaaagtcctaatttgacaactccaattacatcaaatccaacagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctga

SEQ ID NO: 760 - DNA, 2819 bp, Homo sapiens
ggccaatgcactgtcagactaagacagagaaccatcattaattgaagtgagatttttctggcctgagacttgcagggaggcaagaagacactctggacaccactatggacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaagattatttttactgctggaatacttttgtagaaaaccacgaaagaactttcaaagcctgggaagggctgcatgaaaattcagttcgtctctccagacagcttcggcgcatccttttgcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 761 - DNA, 5045 bp, Homo sapiens
gcgggctccggctgccatggaggaggaagaggaggcgataggcttgctggacaaggttctggaggacgaagatgtgtttctcctggaggagtgcgagctgggaaccccgaccagccccggctcagggtcccccttcctggtggctgtgaaggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactc

SEQ ID NO: 762 - DNA, 5252 bp, Homo sapiens
ctcgcccctccgcgctcgcaacttcggcctcccccggctcccgcccgctctccctcctttgttgcgcgatgagggtcgggtttcggatctgaccgagccgccgccgcgggatggagccgctcagccaccggggcctgccgcgcctgtcctggatcgacaccctctacagcaacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactcag

SEQ ID NO: 763 - DNA, 1550 bp, Homo sapiens
ctcgcccctccgcgctcgcaacttcggcctcccccggctcccgcccgctctccctcctttgttgcgcgatgagggtcgggtttcggatctgaccgagccgccgccgcgggatggagccgctcagccaccggggcctgccgcgcctgtcctggatcgacaccctctacagcaacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctctccctgcccgaccccaacctcatcaccttcctcttcctgctggaacacttga

SEQ ID NO: 764 - DNA, 2357 bp, Homo sapiens
ggaagagcactccggagcggctgcccgatgctggagtccgtgcggcagcatcagcaaggtggctgagtggccgggctgctggtgggcgccggggagcctggagcgatggctgcacgctcccgccgcggggacagaggctgccatggagattctcctcattattcgcttctgctgtaactgcacctatgctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaa

SEQ ID NO: 765 - DNA, 1033 bp, Homo sapiens
agggaactagcgggactggcagccgggactgagcgctccacaggcgccttctctccagcgccgcgtcccgtcccccccggcatgaccgacgtcctgccccagcccgactgcagcccgaaggcggggcgcgaacccctggcgctggaggagtcggggagcaagcgcccccccaacaccggcgcccggctctggggccgcgtgcgcaacaagctgctccgaaacaagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgc

SEQ ID NO: 766 - DNA, 5603 bp, Homo sapiens
ggactgcagagggaacttgccttgaagaggcctggtccttaaagagacacagcacacacggcccgaccggcagccccagagcagaggctccactgatggcaggcgcccctggctaggctctgaggttcctttgccctcgccttgctgaatggtgagccgctgcctctcggagcccgtctccttgacagcctgccctcggctcctgcagccactcctgggcctgatggggacagggccagcctggtgggtggtgtcagaggtcctggcagagcagcgtaggcctgggatgcgtctgcagaattctggctgaacgagcgaggagcacggccagcttcggggccgtcgtgaccacaggagggcagagggccagcccgtgagctctgaccccagctggacgtgctcttgtttcccttggggctaaggagattggagccactgaactgaatctctgggttttggagacttagagaatccattggactcttctgctggcgtctttctgaatgctgatggggacttggtgacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactca

SEQ ID NO: 767 - DNA, 1786 bp, Homo sapiens
gttgcgctgccgtcgggcaggtggccgagccccgcgggagctgtcgtcggggccgaattcactgcgccaaggtccagcggaaagctggggcatcccggcgaccgcagggtgtcccttcgcaaattcatcaggcgaaggggaggcggaagctcctggccgctgctctgggggagggctccgagctccaacctgcaagtccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacagcatcaccaaatgccccaaaacttggacccatggagctggccatcattattactgtgcctgtttgcctcctgtccatagctgcgatgctgacagtatgggcatgccagggtcgacagtgctcctacaggaagaaaaagagaccaaatgtggaggaaccactctctgagtgcaatctggtaaatgctggaaaaactctgaaagatctgatttatgatgtgaccgcctctggatctggctctggtctacctctgttggttcaaaggacaattgcaaggacgattgtgcttcaggaaatagtaggaaaaggtagatttggtgaggtgtggcatggaagatggtgtggggaagatgtggctgtgaaaatattctcctccagagatgaaagatcttggtttcgtgaggcagaaatttaccagacggtcatgctgcgacatgaaaacatccttggtttcattgctgctgacaacaaagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagtt

SEQ ID NO: 768 - DNA, 4263 bp, Homo sapiens
aggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtcagagtgccaagccagggaatcccagtcccagactcagagcccgggcctgcactttgccccctgcccttgatcaaccccactgccccaccagagctgccagggtggcacagggccctgtccagcccctggcacacacttccctgccaggcctcagcctctagcataagctccagagagccagggcccatcagtttctctctgtggatttgtatctcagctccatgatgccttgggctttctgtctcctcaacaagagtgcagcttgctgaatgtcagctgcctgagagagctggggcctgacttactagggcattaaatcctaagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcttcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggctcagacagctctgggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggctcaggcccacacccctggccaggcccagagagtgtgtctcaggagaattcaatggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagaccccacagccagaaactgaaagcagcagctccccaaagcctggaaaatccctaagagaaggcctggggcaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcctga

SEQ ID NO: 769 - DNA, 1971 bp, Homo sapiens
aggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctg

SEQ ID NO: 770 - DNA, 1356 bp, Homo sapiens
aaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtca

SEQ ID NO: 771 - DNA, 582 bp, Homo sapiens
aggcggcagggagtagggaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggagggaaaaggccgctatggcgaagtgtggcggggcttgtggcacggtgagagtgtggccgtcaagatcttctcctcgagggatgaacagtcctggttccgggagactgagatctataacacagtgt

SEQ ID NO: 772 - DNA, 4121 bp, Homo sapiens
cggcagggagtagggaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtcagagtgccaagccagggaatcccagtcccagactcagagcccgggcctgcactttgccccctgcccttgatcaaccccactgccccaccagagctgccagggtggcacagggccctgtccagcccctggcacacacttccctgccaggcctcagcctctagcataagctccagagagccagggcccatcagtttctctctgtggatttgtatctcagctccatgatgccttgggctttctgtctcctcaacaagagtgcagcttgctgaatgtcagctgcctgagagagctggggcctgacttactagggcattaaatcctaagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcttcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggctcagacagctctgggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggctcaggcccacacccctggccaggcccagagagtgtgtctcaggagaattcaatggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagaccccacagccagaaactgaaagcagcagctccccaaagcctggaaaatccctaagagaaggcctggggcaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcct

SEQ ID NO: 773 - DNA, 3045 bp, Homo sapiens
gaagagatgtgggcctctggggccgctggattcagtaacttccgtcgggttctagactggctcggctctgtccagtttgtgccagatagtctcccaccccctccccacccctcctttcccctggagatttgaacgctgcttgcatgggagaaaagctacttagagaagaaaacgttccacttagtaacagaagaaaagtcttggttaaaaagttgtcatgaatttggcttttggagagaggcagcaagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggagaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtcaaa

SEQ ID NO: 774 - DNA, 2879 bp, Homo sapiens
gataaacggatccagggcctggttttcagttctataggacttgtccaagaagctatttgtattcatctatcatgaaagatcaaattacatgctaatattctgaaagtaacaccccgccagaaaccctccagcagcagtgaagtctatataaaaccaagccttggcaatttgcacattgccagttccgacagagtgtggtgttaaaaatatttaacaggtcatttttgaaccgtagaaaagaccctgacttaacttacatgttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggagaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtc

SEQ ID NO: 775 - DNA, 2084 bp, Homo sapiens
gaagcgaatagcgtttcagagatattgggcggctcaagggtcttactctgtcgcccagtctgtaatgcagtgctgtgaccatagcccactgcagcctccacctcccaggctcaagcagtccttcccccctcgccctcatgaatagctgggactacagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggagaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaac

SEQ ID NO: 776 - DNA, 531 bp, Homo sapiens
ggtctatcggaagtttaaagcaatgcagcgggaagtaccttgcctttttgaagcgaatagcgtttcagagatattgggcggctcaagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctg

SEQ ID NO: 777 - DNA, 536 bp, Homo sapiens
actccgcctcccccggctcagcccccggccgcggcgggacccgaggtgggctcagccttctttccttcaattcctgtttcagtctcattttcatggactggtccccaaacttgtctgcattggaagcacctggggagtttctagacctgagcctgtgcccacctcatgagggtcttactctgtcgcccagtctgtaatgcagtgctgtgaccatagcccactgcagcctccacctcccaggctcaagcagtccttcccccctcgccctcatgaatagctgggactacagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatgga

SEQ ID NO: 778 - DNA, 550 bp, Homo sapiens
ctgcagcgcccggctgcctcgcactccgcctcccccggctcagcccccggccgcggcgggacccgagagtttcgctcttgttgtccaggctggagtggaatggcgtgatctcggctcaccgtgatctcggctcaccgtaacctccgcctctcagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttcc

SEQ ID NO: 779 - DNA, 2861 bp, Homo sapiens
ctgcagcgcccggctgcctcgcactccgcctcccccggctcagcccccggccgcggcgggacccgagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggagaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtc

SEQ ID NO: 780 - DNA, 534 bp, Homo sapiens
gcagccgcggaacaaaactgtcttgctttgggcctgaactgctggtgggatatggggggtgggggggcagaggcgtggagcgggggtctcagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccc

SEQ ID NO: 781 - DNA, 564 bp, Homo sapiens
actccgcctcccccggctcagcccccggccgcggcgggacccgagggtcttactctgtcgcccagtctgtaatgcagtgctgtgaccatagcccactgcagcctccacctcccaggctcaagcagtccttcccccctcgccctcatgaatagctgggactacagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggt

SEQ ID NO: 782 - DNA, 4563 bp, Homo sapiens
ggggaggcgccgggggcgcgcgcgcgcgcgctgggcgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccatgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacaga

SEQ ID NO: 783 - DNA, 1665 bp, Homo sapiens
atggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatagcgttgtgtgttatggtaaccattctgaaggctcgtttggctttataaacaaacaaacattgttttattagtccgtggcggggagtgccccggtgcgcatagcacgggattcatgcagtggtctccttcacatcagaagcagtatattctaacgcggtggctcccaagccacattcatgggaaaccctgctgtttcattgtt

SEQ ID NO: 784 - DNA, 1782 bp, Homo sapiens
cgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggtaagaagctggcctcctgcggctttcccatcagcctgatttctccaccttagaaaagggtttcttgacaatggggtcaggccccagaggagccccctgagagtgtcagttattatttactattacgtgctattttacatatcccaagccctttagggctacagtctcttgtcctggaccctgtagggtgccatttggagttcacagcctagaagaagaaaaggctttgggcctggtgtggtggcataggcctgtaatcgtagcgctttgagaggctgaggcaggaagatagcttgagctcagaagttcgagacaaacctgggcaatgtggggagaccccatctctac

SEQ ID NO: 785 - DNA, 1791 bp, Homo sapiens
gcgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagcagactgctcattcctcacattgccatgggaagttgtaatggtctctgctgcccccaagctgaggagccttagactccaatacaagggaggaaggggaagagcaagatttttattcccactgaataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtgg

SEQ ID NO: 786 - DNA, 2362 bp, Homo sapiens
aatgcttctcctaagcacctcgtgtgtgttcttcggcctcactgctctgtggcttaggtatctgtgctgtggggtttgagaaacatggtgaaggtgtatgaacagagcttgacatttgtgctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgt

SEQ ID NO: 787 - DNA, 3385 bp, Homo sapiens
gccgggcacagggccgcctttgcctgcctgccctgcagcagcaggcccgggcggctgcgagagggcgcagggggcggaggcgcggcaggggcgggctctgccgcccgccccaccacccgctccccgcccggctgcggggccagtggcaggagcgccgcgcaccgccagccgcagggggcgtgggatgggggcggccggggaggggggcgcccacactgactagagccaaccgcgcacttcaaaagggtgtcggtgccgcgctcccctcccgcggcccgggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacagcatcaccaaatgccccaaaacttggacccatggagctggccatcattattactgtgcctgtttgcctcctgtccatagctgcgatgctgacagtatgggcatgccagggtcgacagtgctcctacaggaagaaaaagagaccaaatgtggaggaaccactctctgagtgcaatctggtaaatgctggaaaaactctgaaagatctgatttatgatgtgaccgcctctggatctggctctggtctacctctgttggttcaaaggacaattgcaaggacgattgtgcttcaggaaatagtaggaaaaggtagatttggtgaggtgtggcatggaagatggtgtggggaagatgtggctgtgaaaatattctcctccagagatgaaagatcttggtttcgtgaggcagaaatttaccagacggtcatgctgcgacatgaaaacatccttggtttcattgctgctgacaacaaagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagttgacttcatccaatctctatgttatgtttaattttattttgaaagcaacacctcaactcatctttttatttaataaggaagaaatatattacaaaagtataaaataagctctataaaaatgttatagtcattaagtttttattttacttgaaccaagagcacatgaatgaacaggaaaagatgtaaaaacatttttttctgagatgaaaacatattaattaaacatgcaaattagagcatgctatctttaggtgatgcaatctatgtttccccctttttaagttagcaggactttttaaaaataaatattgctctaaactttaatatatcgaacgtgagagtggagctgcttagtggaagatgtaagtgaggtgggtgtcccatgtgcttggtctccccttctgctgttctcctgttcttcataatccactactgcagcagtccctgaaccactaaacttgttcctttcatttacaaaagagatacctgacatcctgagacactgagaaatgtcctgaagtcacacagctaatggcagaactggcactaggtccaaatcttgtgataatgaacaccgtaaggttagctagcttcctactttcccttgaatagtgcttttctccctatgtaatatcttttattatgatatttgtggtttagaaggcatattgagttattttgcagaatcataatggacccgcacaaaatctcagaaccatatctgttgacattttttctcatagaaatatcatggttaccccatttgttaatgagcattaatgttttctgaacacttccaaagattaatcaaacataaatattcattgtctgaaaatgtctttaagatacaattcagaggtccctatttcctttgtacatacacacttagaaagaaaagacagaaaaggaagaggaaggaaggaaatattttgagaatatattgagaagaattaagaaaactcttcaatgaagtgttaacaaccaaaccctacagacggtatcagaaacagcaaatagatattcctctaccctttcacagtgagtgagtgagtacagaagaatgctcatgatagttttgccttcattctactttctgtggacacagagtaatgaatatttaatgggacattaaatatgcccttcaaatctataattttactttggtaaacgagatttaacatgatgtcttttatgctcctaaaacatcttttttcaaactccattccttagaacattcttctactgagatgatccaagaccaaaagtgttctttggtacttgcttataaagtgatagtacatgttagcatataatgtattttgaagagtgaagtaaatgctattgataacagtaaaaaaaaaaaaaaa

SEQ ID NO: 788 - DNA, 1501 bp, Homo sapiens
ggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacaggtctacctctgttggttcaaaggacaattgcaaggacgattgtgcttcaggaaatagtaggaaaaggtagatttggtgaggtgtggcatggaagatggtgtggggaagatgtggctgtgaaaatattctcctccagagatgaaagatcttggtttcgtgaggcagaaatttaccagacggtcatgctgcgacatgaaaacatccttggtttcattgctgctgacaacaaagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagtt

SEQ ID NO: 789 - DNA, 1270 bp, Homo sapiens
ggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagtt

SEQ ID NO: 790 - DNA, 5728 bp, Homo sapiens
aggagaccgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaaggtcggtccggacatcggacccagtcagttcccagactgtccgggcggcagcggacgccgctgccgccgccgcctcttcgtcgcctcagcctggcgttttgttccgagagacgggagaggcgagcggagctgacagtgattttgacagtgatttaaacccgcttttgttgttgttggcttttcgttgtttggttttgtgtgttgtgcgtgtgtgtggcggtttttcccccgtggtgcattttattttttatcgttgtgctcttttttttcttttttttttttaacccagtgagcgtttttttttttttttttttttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcctcatgactcgtcttgtattttgcctttctgatacccatcagaactgctgctgctctaacttatactctttaccttgcccagatctccgcgtaaggaatgctttatgatcaacttgccataggactgatggattaaccagtgttcggctttatttgaagtctatgccctgcacagctcttgtatgtattttagatgctagaagtttttttagcatgtgatgtgtgattcttgtttgaattctaggtaccttgtgaattccagaaaaagagactgtgcttcacgattgttagtcccatgaacttgcactatctatctttcatggtgatgttttgaaaatacaatcaggaaaaaacccaacacctttggaatttaaaatagaatcatatcatgaaatttaaaaagaatctcttctgttgcatttcctcacccctaagtaacagctacatttaagtaaaatgcaggtggtaggggaaaaaaaaccatggcgagatggtggtttagtggaataaactgattactggtttttttgtttttttttttttttttaaagaaagaagcttcatcacagatactttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggta

SEQ ID NO: 791 - DNA, 2367 bp, Homo sapiens
gccgccccttccccgcgccgcagccgcctcgccgccaccgccgcgagctcggccgccagtggtcctcggactttaggtgtctgggttgaaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcga

SEQ ID NO: 792 - DNA, 1956 bp, Homo sapiens
aggagaccgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcag

SEQ ID NO: 793 - DNA, 2136 bp, Homo sapiens
cgcccgcctctttgtatccaacatccgggtttccccgctggctcggctccgtggccgccgctcaggagccattttggactcggttcagctcccctcccccccacccctccccccgttcatggcccctccggactcggcccctgcgcccggggcccgggcccagccccgccgcgctatgcctgagtcgggcgcgccccggcccgtgccccgccgccgccccccggcccccgcgtcgccccggagcccgggccgcagcctgcgccgcccgcagcggccctgagcccggccccgccgaccggcccttggagcccgaacgctgctcggggacgaaggcgcaggaagcgcgcagggaacgagaccgaaggaaggagcgggaaggagagcgcagccgccgcctggccctgcgcgccccgggagcgccgtgcggccctgcccgcgggctccgggtgtgcgcggggcggcgccgcggaacatgacggcgccctgggtggccctcgccctcctctggggatcgctgtgcgccggctctgggcgtggggaggctgagacacgggagtgcatctactacaacgccaactgggagctggagcgcaccaaccagagcggcctggagcgctgcgaaggcgagcaggacaagcggctgcactgctacgcctcctggcgcaacagctctggcaccatcgagctcgtgaagaagggctgctggctagatgacttcaactgctacgataggcaggagtgtgtggccactgaggagaacccccaggtgtacttctgctgctgtgaaggcaacttctgcaacgaacgcttcactcatttgccagaggctgggggcccggaagtcacgtacgagccacccccgacagcccccaccctgctcacggtgctggcctactcactgctgcccatcgggggcctttccctcatcgtcctgctggccttttggatgtaccggcatcgcaagcccccctacggtcatgtggacatccatgaggaccctgggcctccaccaccatcccctctggtgggcctgaagccactgcagctgctggagatcaaggctcgggggcgctttggctgtgtctggaaggcccagctcatgaatgactttgtagctgtcaagatcttcccactccaggacaagcagtcgtggcagagtgaacgggagatcttcagcacacctggcatgaagcacgagaacctgctacagttcattgctgccgagaagcgaggctccaacctcgaagtagagctgtggctcatcacggccttccatgacaagggctccctcacggattacctcaaggggaacatcatcacatggaacgaactgtgtcatgtagcagagacgatgtcacgaggcctctcatacctgcatgaggatgtgccctggtgccgtggcgagggccacaagccgtctattgcccacagggactttaaaagtaagaatgtattgctgaagagcgacctcacagccgtgctggctgactttggcttggctgttcgatttgagccagggaaacctccaggggacacccacggacaggtaggcacgagacggtacatggctcctgaggtgctcgagggagccatcaacttccagagagatgccttcctgcgcattgacatgtatgccatggggttggtgctgtgggagcttgtgtctcgctgcaaggctgcagacggacccgtggatgagtacatgctgccctttgaggaagagattggccagcacccttcgttggaggagctgcaggaggtggtggtgcacaagaagatgaggcccaccattaaagatcactggttgaaacacccgggcctggcccagctttgtgtgaccatcgaggagtgctgggaccatgatgcagaggctcgcttgtccgcgggctgtgtggaggagcgggtgtccctgattcggaggtcggtcaacggcactacctcggactgtctcgtttccctggtgacctctgtcaccaatgtggacctgccccctaaagagtcaagcatctaagcccaggacatgagtgtctgtccagactcagtggatctgaagaaaaaaggaaaaaaagttgtgttttgttttggaaatcccataaaaccaacaaacacataaaatgcagctgctattttaccttg

SEQ ID NO: 794 - DNA, 2943 bp, Homo sapiens
tcgggcgcggcgtcctccctccgcagcagccgagccggacctgcctccccgggcgtgctccgccggccccgccgccggcccgcagcgacagacaggcgctccccgcagctccgcacgggacccaggccgccggaccccagcgccggaccaccctctgtccgccccgaggagtttgccgcctgccggagcacctgcgcacagatggagctggaccaccggaccagcggcgggctccacgcctaccccgggccgcggggcgggcaggtggccaagcccaacgtgatcctgcagatcgggaagtgccgggccgagatgctggagcacgtgcggcggacgcaccggcacctgctggccgaggtgtccaagcaggtggagcgcgagctgaaggggctgcaccggtcggtcgggaagctggagagcaacctggacggctacgtgcccacgagcgactcgcagcgctggaagaagtccatcaaggcctgcctgtgccgctgccaggagaccatcgccaacctggagcgctgggtcaagcgcgagatgcacgtgtggcgcgaggtgttctaccgcctggagcgctgggccgaccgcctggagtccacgggcggcaagtacccggtgggcagcgagtcagcccgccacaccgtttccgtgggcgtggggggtcccgagagctactgccacgaggcagacggctacgactacaccgtcagcccctacgccatcaccccgcccccagccgctggcgagctgcccgggcaggagcccgccgaggcccagcagtaccagccgtgggtccccggcgaggacgggcagcccagccccggcgtggacacgcagatcttcgaggaccctcgagagttcctgagccacctagaggagtacttgcggcaggtgggcggctctgaggagtactggctgtcccagatccagaatcacatgaacgggccggccaagaagtggtgggagttcaagcagggctccgtgaagaactgggtggagttcaagaaggagttcctgcagtacagcgagggcacgctgtcccgagaggccatccagcgcgagctggacctgccgcagaagcagggcgagccgctggaccagttcctgtggcgcaagcgggacctgtaccagacgctctacgtggacgcggacgaggaggagatcatccagtacgtggtgggcaccctgcagcccaagctcaagcgtttcctgcgccaccccctgcccaagaccctggagcagctcatccagaggggcatggaggtgcaggatgacctggagcaggcggccgagccggccggcccccacctcccggtggaggatgaggcggagaccctcacgcccgcccccaacagcgagtccgtggccagtgaccggacccagcccgagtagagggcatcccggagcccccagcctgcccactacatccagcctgtggctttgcccaccaggacttttgagctggggctgactcctgcaggggaagccctggtccagctgggtgccccctcgagctccgggcggactcgcacacactcgtgtcatccagatgtgagcaccgcacccagcggcaaagagccctcccccctgcagggctccacccatcaccctccctccgtctgtctttccggcctggaccccaccctccacactctcaggccatcacagaacaccccagcttcctcattctgctacaacacccaggccctctggacatccagaaaaccaagtgtccggatggcaggggccagcggccaccaagctcatgggacacccagagcagaagctagggcagagccaatgctgagggagcctcgacttccggcgccgccgccctctcccggcatccgcagagccagctgacgccctccctgcctcccagggcagctggccagcctcgggcagcgcggccccctcctcccaggggagagtagaagtcgcacacgcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacaggtctcaaggttcccacaaagtctttgctgctgtgctgggcaccacccacccctcaccttgcaggctgcctgcgtgggaggcgaagtcccaggacagcccagaggggggctacagagaggagtcggctgcagcagagggcaggagccccagcttagccctgagcgccagcgcgaggaccagggcctgccactaagcccgccccgctggccgccagctgcccgtccccagagccactgcagcaggagtcgggccctgcctccctcccagcagggaaaccccgcccgctgccaggccatcctctctgccagaggctttcatgagccccaaggctggggccacagctcctacccctgcccagcagccctgagctcagctgcaggaaggacatcccagaagccatggctcctggggcgcttccaggcattctgccctgccccgacaccagaaccctggtgctggtgggccactagcgtctgcagcctaagcaggtgctggctcagggttcatcgttctgccttgtccactgggggaccagccctgcagaccactctgacaagtcttcagcccacaccctgccagccccacagattttatttttgcacataagccataaccaatcctcaaggctggcacaggctttggggaagccctggagcctgtgaagaccctggaaacctcatgaggctgtggccaacccctgccccttgccccacacagaccaggccttaaatgtcggtccaggccctgtgcaccttaccccagagacagactctttttgtaagattttgttaataaaacactgaaacttc

SEQ ID NO: 795 - DNA, 3573 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagaaaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 796 - DNA, 4142 bp, Homo sapiens
gcctccgaccggcgacgcaggttacctgtagggattcgaatccaccacctctgagctcatcttctcgatgcggacccggccgccccctccgtcgccgctcctcgggacctgcagactcctctcctgggcaagttcccgctccagctcctggacccgctgctgcaggcgctccacagactccgccatggctgggactccggccgccaacgctcccagcccgggccttcgccgccgccttcgccccacgttgctcggctgggcccgcgaggggtacgtggggaggcacctcgccgctgccttcctagcccagagccctggggacgtgcacccagcgcctcacagacagacacgtctccgagactcccacaggccttcctcggagccgcttccggtgcgtcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtcc

SEQ ID NO: 797 - DNA, 3244 bp, Homo sapiens
ttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagagaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtccttacaa

SEQ ID NO: 798 - DNA, 2940 bp, Homo sapiens
ctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtgg

SEQ ID NO: 799 - DNA, 2249 bp, Homo sapiens
agggtgcagtgggacaggcgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 800 - DNA, 1336 bp, Homo sapiens
aacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctca

SEQ ID NO: 801 - DNA, 2169 bp, Homo sapiens
agactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctggggtgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggctttt

SEQ ID NO: 802 - DNA, 1189 bp, Homo sapiens
gaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaagcatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagaaaaagcaagagactttgaagctttggatcacttagaaaaggcgcctccgagatgtcttaccgaggctcctgcaccaggtgctggtctaagcccctcagtcttgtctggttctctgctccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccag

SEQ ID NO: 803 - DNA, 2454 bp, Homo sapiens
agtaacgtcatcagacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 804 - DNA, 2401 bp, Homo sapiens
gctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctc

SEQ ID NO: 805 - DNA, 2393 bp, Homo sapiens
gctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagaagcagattaagaaagtgtcccagcagatccttgagaagcgagcctatatctgtgcccaccctctggacaggacatgctgagaggggacagtgtcccctgctaccgcccgcccctacccatggcccgttgctggatgactgttactcttttttcagaaggttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctc

SEQ ID NO: 806 - DNA, 1950 bp, Homo sapiens
tggaggccccgccccctggccgcgagcgcacctcggccccgctcccgaggccctacgggcgtggcctctgtcccgggtcccgccccccagcactccggaacagcgcgctcgcagcgggaggtcgcgaagcctgggactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggcctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccca

SEQ ID NO: 807 - DNA, 2172 bp, Homo sapiens
agaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtgactacagtgtttgcccacttttggaagcttgcactctatacctagatgcgtttttccttcttctaactggttccaaccttaacttgcacctaaaccttggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgctta

SEQ ID NO: 808 - DNA, 2619 bp, Homo sapiens
accgcgccgcaagtccccccaccgttcagcgcaaccgggccctcccagccccgccgccgtccccctcccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagacttcagaaaatataaatatgaaataatttaagaacccaaa

SEQ ID NO: 809 - DNA, 1332 bp, Homo sapiens
gagccaacatggcagcggggttcgggcgatgctgcaggtgttctttacaggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgt

SEQ ID NO: 810 - DNA, 1454 bp, Homo sapiens
attattgtccgagtggccggaacgggagccaacatggcagcggggttcgggcgatgctgcaggagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctaga

SEQ ID NO: 811 - DNA, 1422 bp, Homo sapiens
gtggccggaacgggagccaacatggcagcggggttcgggcgatgctgcaggagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagt

SEQ ID NO: 812 - DNA, 2543 bp, Homo sapiens
agcagtttcgctgtaaaatcctattgctgacagccaagacgggcgtattccctcgcgaccagcctgtggcgtggttggggctccggaagggcgcgcgcgagcgcttttttgggaggacaccacaggtggacgcctcagctgatcgtcctccctcccggggaccctgccccgagtcgccgagtagccgcagagtcgcctccgtcgccccgccgcccctgtgtttcggacatggccgcacgccttctccgagggtccctacgcgtcctgggcggccaccgtgcgccgcgccagctgcccgccgcgcgatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagaatgggagaaagctggagaagtaagtagggaggtttgggaaaaagctggaaaacaaggactgcttggtgtcaatattgcagagcatcttggtggaattggaggggatctgtactccgcagctattgtctgggaggagcaagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaagtgacttacagggaataaaaacaaatgctaaaaaggatggaagtgactggattctcaatggaagcaaggtgttcatcagtaatgggtcattaagtgatgttgtgattgtagttgcggtcacaaatcatgaagctccctcccctgcccatggtattagcctttttctggtggaaaatggaatgaaaggatttatcaagggacgaaagctacataaaatgggattaaaagcccaggataccgcagaactattctttgaagatatacggttgccagctagtgccctacttggagaagagaataaaggcttctattacatcatgaaagagcttccacaggaaaggctgttaattgctgatgtggcaatttcagctagtgaattcatgtttgaagaaaccaggaactatgttaaacaaagaaaagcttttggcaaaacagttgctcacctacagacagtgcaacataaattagcagaattaaaaacacatatatgtgtaacccgagcatttgtggacaactgtctccagctgcatgaagcgaaacgtttggactccgccactgcttgcatggcgaaatattgggcatctgagttacaaaatagtgtagcttacgactgtgtacagctccatggaggttggggatacatgtgggagtacccaattgcaaaagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggaaataaaatataaatataagattaacacagtggaaggacaaatctttgaagccaaaattctagttttccaatataaggtttaacttacagttttttatgtagccaaaggtaaacggttttctgaatcttgcctaggtgtttcatttatctctaaaattctaaaaagcataaatcattcaaatcttcaaaccaaggcagaaataattttatgtcgctatagtataaaaacattaataagatagcacattgacttttaaagggaaaagtaaatataacttagcatgtaaactcatttcggctaccatttgctccaaattccctagaacagtggtttttaccactgtactccaaccccgtttttaagcaatggaactctttcttcaaacaaaagcttatgcagaacatctctgtgaaacgctgctgagtgagaactgctttcattgaagctggaagccatcataccttactgccttgaaacccctaggactcagctaagtatttgcctaaccctgaccagggaatgccttggttctgtcaattgctgacatctgagaacacagaataatccatcatttttaatttcaagatattggtacattttataggtatcaaagcaatggcttttcttttgcaacagttaatgtatttattaacttaataattactttatgtcttctataaaccaggctgttaatacaatgatgacaaacaaaactggcaagatcactaaaaaataagtgaataaacaaataagtagtaaaataaggtaagaagtaaatatgtaaaagagataatttcaagcataagtgcaatgtaaataataaagtaagcatttaaaattcaaaagtgaggaaatgacatttgatttaagacttaaaagtaattacaaaaaataaa

SEQ ID NO: 813 - DNA, 5859 bp, Homo sapiens
ggcctgcggcgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatattctgtcatgcactatttttcagttgacaatttctgtattttaattgaatactgtttcttcagtcatggttattgcactttatcctgaataataattcagaaattgggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctgataaagacatacctgagaccaggaagaaaaagaggtttaattggacttacagttccacatgactggggaggcctcagaatcatggtgggaggcaaaaagcacttcttacatggcggcagcaagagaaaatgagaaagaagcaaaagtggaaacccctaataaacctatcagatcttgtgagacttactatcacgagaatagcacaggaaagactggcccccatgattcaattacctcccccgggtccctcccacaacacatgggaattctgagagataccatttaagttgagatttcagtggggacacagccaaaccatatcattctacccctggcacctccaaatctcatgtcctcacatttcaaaaccaatcatgccttcccaacagtcccccaaagtcttaactcatttcagcattaacccaaaagtccgcagtccaaagtttcatctgagacaaggcaagtcccttccacttatgaacctgtaaaatcaaaagtaaactagttacttcctagatacaatgggggtacaggtattgggtaaatacagccattccaaatgggagaaattggccaacacaaaagggtaacagggcccatgcaagtccaaaattcagcagggcagtcaaattttaaacctccaaaatgatcacctttgactccacgtctcacaatcatctctctcaagttcgaagttccacaaatctctaaggcaagggaaagatgctgccagtctctttgctaaaacacagcaagagtcacctttactccagttcccaaaaagtttttcatctccatctgagaccacctcagcctgaattttattgtcaatattgctatcagcattttgggcaaagccattcagcaagtatctaggaagttccaaactttcccacattttcctgtcttcttctgagcccttcaaactgttccaacctctgcctgttacccagttccaaacttgctttcatatttttggctatcttttcagcaatgccccactctactgttagcagtttactgtattagtctgttttcacactgctgataaagacattcctcaagattgtgaagaaaaagaggtttaattggacttacagttccacatggccggggaggcctcagaatcatggcgggaggtgaaaagcacttcgtacatggtggtggcaagagaaaatgaagaagaagcaaaagtggaaacccctgataaacccatcagatctcatgagacttactatcatgagaatagcacaggaaagactggcccccctgattcgatgacctccccctgggtccctcccacaacatgtgggaattccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcactctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaagataaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactggagatttttggtactcttataaa

SEQ ID NO: 814 - DNA, 1599 bp, Homo sapiens
aggggctggctagagacccagaggcgcagagcggagaggcctgcggcgaggatggagggcctggcagtgcggttgctgcgcggcagcagctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcct

SEQ ID NO: 815 - DNA, 2287 bp, Homo sapiens
tacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtc

SEQ ID NO: 816 - DNA, 2221 bp, Homo sapiens
tacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcaggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtc

SEQ ID NO: 817 - DNA, 2312 bp, Homo sapiens
gcagggccgggctccagggaactacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcatg

SEQ ID NO: 818 - DNA, 2204 bp, Homo sapiens
acagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgcctgctctcaagagcacttactgcctcgcaaataataaaaatttctagccagt

SEQ ID NO: 819 - DNA, 2226 bp, Homo sapiens
gtcactatacagagacagtccatgttggggggcctggccgcggcggcgggaacccggataatgggaaaggagatagaagcagaagcacagaggcccctgaggcaaacatggagacctggccagccaccagcgatgacagcaaagacgatgagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtc

SEQ ID NO: 820 - DNA, 7506 bp, Homo sapiens
cgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatact

SEQ ID NO: 821 - DNA, 7577 bp, Homo sapiens
aaaaagtgctttattttcccactccccggacgcccagcagggcagtttcttgaccttcggagcccctttcccgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatact

SEQ ID NO: 822 - DNA, 7751 bp, Homo sapiens
aaaaagtgctttattttcccactccccggacgcccagcagggcagtttcttgaccttcggagcccctttcccgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcggtgagggcggcgggcgagacctccctcctttcccgagaaaagctggagactccctcgatgcggagtcaggggcgctgtggggcctaggccctctggcccagcgttaggggagccgggacccccacttcgaggaacagcctgtgtccctggtggggggatatcgccattccccagagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatact

SEQ ID NO: 823 - DNA, 2417 bp, Homo sapiens
agattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacgttttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcag

SEQ ID NO: 824 - DNA, 2772 bp, Homo sapiens
agattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctg

SEQ ID NO: 825 - DNA, 2426 bp, Homo sapiens
acaagggcttgagagcagacaagggcttgagagcagacaagggcttgagagctggccaagcagtttctctcagcttctgtgttccagcccctatgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccatagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattaga

SEQ ID NO: 826 - DNA, 708 bp, Homo sapiens
ctacagccggggagaggccagcccggcctacagtgcggacacaggacagaggggagccagccctggctgacacccagccctaggcagttcctcttgcacacaggttctttgcactgaccaatgctgagagcagaccctcggagcagccgggttggaagtgtctctccatagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatg

SEQ ID NO: 827 - DNA, 2423 bp, Homo sapiens
cgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtc

SEQ ID NO: 828 - DNA, 2374 bp, Homo sapiens
aaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctga

SEQ ID NO: 829 - DNA, 2253 bp, Homo sapiens
atgggacggacggaggccgagaggcgtggcgggggagcagtggggccaggccagagacagctgcgctgtgcgggcagctagtcccagtactccgagtcggtcgcgggccgacaggcatcccctgagcgcctgctgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctag

SEQ ID NO: 830 - DNA, 6357 bp, Homo sapiens
aaaccacaaagaaaaggaaagttttaattctgagaaacttcactgaggagcaattttttttgagcttctaaaaatagagaggaaatgagcctctttgggtcactctagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtcaacaaggacctgattttttttgtcaattgagcaggtgggaccagtgcagagagtagtgggcatttaactcacaggactgtgcacagcgggcatgcgagtgaccattagtgccctggaataaacaaaggtgcaggatggggtcaagtggcgcattctcataaaagcagccagctctacgttagcctgtcgccaccagaccaccccacttccattctgaatacgggaagcagccattctcagtagcaagctgagccaaaatgaccgaaggcatctgaacaggaaacaggtagagaaagcaaacatctcagttttggaattctttattactttgaacccaagagccactgataactggcacaatccaatgaaacagaggaagcagcagcttaaacaaaggaaaatacatttaagattataagtctgggggggcggttacaagcttaaaaagtgacccagacagggatatcattgctaaaaaaaaaaaaatccccttgtgacctgggtacattttgcaaagccacaggtttgcaatgttacacaagggccaaaggaggccatgagttgtctttggttgtggggacagagggtaactgttcatgaaaatagtgagtgtctgaagattaagaaaatcatgctgcagcagaggagaagggagaggaagacaggaagggaaaggagatgcctgagggtcaaaagctgagcccaagcctaagcccaagctcaagctcaagccccagcatggcataattttgtgaattaactcaggctgagttgcctccagtctttggaatgtcatcttatactggtactgctgaggcagagggcagtaattggtgctttgggataggagaaggggcagttgctgaaatacaaaattaatagcatcccaagttcctcaattgcagccaaaatacatgtgttcgggcctttcggcagtatcgcccccagaactacctgctgtagtgtggtccattcccagacagcaacatgcaagaataagtttacaatacactcagcccttctggcttcagatcaggggctcagaggctgtgacaactcatgatgctgaaaatgtatccagtgaaaatgaagtactagctctctgcttcattaaaagctcttggaaagaatattaaatctcaagacaacaaaataattgaacacacaatacatttgtgtctttgtatccaatatattacctttgtcttattaacaaaaattatatctctcattatatatttcttggatctgaagtttttattcacactcagtaatttctgtaaaggacaaatctgtctctattttccatatcatttagaaatataccacattcactctttttgatgtgaactttcccaggaaaattctcttgtgcccatttagttttagaagagtgtcattttgtgctattatgtcaatatcctgttttatttccattatgtttttcaaaaaccgaagaaaataaggtttttcttaaaaagttagacattttctcttgttaattctgtatcctgttatttacagctgaagagaaactattttaacttaagtgtaaaatggtttagaatagcaaatgatacagtccactcagagtttacaaaaaaaacatttaccaggtagacacttaataaataaaacaagcacttggaaaaagttctttgaaaacagacctagggacatccacctgcatcttttgcacagattttgttaagaaaaggccagatctaaaaatgtactgtcaagaaacaagcaaaccaatgcatacatacgtaggtattctaaacagaggttcatgtggtgtccatttagagtgactgatgtaaatgccagttgtagaagtgttaatctaaatcttttactcggcgacagatttcctctgtgaagtctgagcattttgcattgcctcccaaatcttttgtcaagctctgagaaaaggaaaaagcaaaaataaaagatgtatccgcaaactaaactaaaccaaggagattttaaagccctcagtgagatgccacctgggcaagttactcggctgctctttcatttagttcctcatttcaaagtgaggaaccactccaccaccatctacccagcccaggaggatcgggatccaatctcatagtgtatacaacagcactctgcaaagaataaggtgctcttgatgcaaagggaggcagggagctttaccaaaattttccctttgttcacacaatagaccctaacccagattagttggtcatggatatttaaataaaagcgaatctaaataagaagtttcataaaaatccttgggaaatatgtctcaggaatagacctgagacatattttgatctatttttgtttttattattattttttttttagatggagtctcactctgttgcccaggctggagtgcagtggcacgatcccagctcaccacaacctctgcctcctgggttcaagcgattctcctgcctcagcgtcctgaatagctggaattacaagtgcatgccaccatacccaactaatttttgtatctgatctatttttggaggctgggacacaaatacgaaagaaatatttaaatcattaactcttttttttttttttaagagacggggtctcactatgtggcccaggctggtcttgaactcagaggctaaggtgatcctcctgcctcagcctatagctgcaactacaggcatgcaccaccacacctgcctaaatcattaactcttaaacctccctctttaggaaagaaagcctcccatacaactgatctgttctaccagcttatcctttctttcctgcatacagaccccaatatatttaattctctttatctttccatcctacacaataaaagggcccactatgtaattcaggcacctctctactgggctgtagattataacttcccaaatataactttaaagaataagaaaatcatatgacctccaatgtgactatcaggctgttaaaaacaagcctgaatttcttgtattttggccacacgatataatttcaaattacagaatttttttaaaagaagggaccaactttgaagatattacgctaagtgaaataagccagactcaaaggacaaatactgtatgattccacttacatgaggtacctagagtagtcaaattcatagagacaggaagcagaatggcaggtgtcagaggatgggagggggaagggaaagttactgtttaacgggtgcagagtctcagtttgagaaaatgaaactggtctggagatgactgatggtgatggttacattacaatgtgaatgtacttaacattattgaactgtatacctaaatacggctaaaatggcaaattttatgttatgcatatttttcacaatttttgttaaaaaggacctcaaattagg

SEQ ID NO: 831 - DNA, 2257 bp, Homo sapiens
gtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacag

SEQ ID NO: 832 - DNA, 2712 bp, Homo sapiens
ccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggtttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttg

SEQ ID NO: 833 - DNA, 2235 bp, Homo sapiens
ataggcagaggccaccctccccgcctccccgcccgctgcgcgcccgccccgccccggctcactttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttg

SEQ ID NO: 834 - DNA, 2251 bp, Homo sapiens
ctttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagtgcaaggggtgggatggaagctggcaggcagaggatttcagttcccagtagcttcactgcctctgcagcagcacattccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggc

SEQ ID NO: 835 - DNA, 2098 bp, Homo sapiens
aaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttc

SEQ ID NO: 836 - DNA, 1881 bp, Homo sapiens
actttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtc

SEQ ID NO: 837 - DNA, 1745 bp, Homo sapiens
ataggcagaggccaccctccccgcctccccgcccgctgcgcgcccgccccgccccggctcactttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcaggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtc

SEQ ID NO: 838 - DNA, 3664 bp, Homo sapiens
gggggacgcgcttgggcgacggacgcgccgcgccggggaagctgttgggcgccggaactggtccggcccgactcacgaccccgcgggacccggccggaacccggcccgaccccggcgcgcgcgcggcggaggacgaggaagagttgtggcgaggcagatcctgccccgtggccgcggccgtctcgtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctggctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaagcccctgtcccacgccgtctgcacgtgcctgtgcctcacccagagccagtgtctcccggcccacataggaggtctgggcagccacccagggggccctcctgggaggagctgagggttcacaagcctcccagaaccagccctgtcccatgggttccgtgcatttcctggtgctgctcttggaggagagcagctcccactgtggggacacctgccaccctgcacactactgtgtgtccatcagcatgtgtcacagaaagtgcgtggacggatggccccggagctgctctgccgtgaccctgcctcaccccccagcgcagggactttccaggtcatctccacaccagcccctcagccggtgaaccctctctcccatcaccgtctccacccagacccccacctgccccatggcccccatttcatgtctgtggctcaccagcttttccccagacccagctccggagcccacaggcgtggccgatgcagaaacctcaggaaggtgtgttgtgaatgttgggtgcacccacgttgcatttacttagcggggccaattcagatgcacaggggccacatgcagaatccagaagtttctggacaattttcagaagaataggctgcctcctccccacagcctgggggaagtaacagtcatcgcccagcagtgtctggcctgaacttacccagaacattctgcccccggaatgcacgtctgaaagagtggccagaaacgagtgtgccgggcaggaggccagccccatctcaggctcacgtgcctctgacaggagaccagccccatctcaggctcacatgcctcgcggacagttggacgtggcctggggcccctgctcacttgagcatgtcgcccaccaagcttgtctgaggccacagagcagcgtcccagccctgttttccaggactggtgggtgccccagtccacggccctgccccacccgaactcctgcctcacggtgtggccttgtgcatccccatggcctgaccccgggaacagtcagaggaaggggtcccgccctcccgccagaggcctggacccaagggaacggcagtcagagactacagtccagacgtttgtgtctaggccttgctggtagctaaggaaatgccttctgttgggaaaaggtcaaatttaacatagcaaaatttttacttaattccactaa

SEQ ID NO: 839 - DNA, 2247 bp, Homo sapiens
acgaccccgcgggacccggccggaacccggcccgaccccggcgcgcgcgcggcggaggacgaggaagagttgtggcgaggcagatcctgccccgtggccgcggccgtctcgtagctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaag

SEQ ID NO: 840 - DNA, 869 bp, Homo sapiens
gggcgccggaactggtccggcccgactcacgaccccgcgggacccggccggaacccggcccgaccccggcgcgcgcgcggcggaggacgaggaagagttgtggcgaggcagatcctgccccgtggccgcggccgtctcctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtg

SEQ ID NO: 841 - DNA, 3832 bp, Homo sapiens
ggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttc

SEQ ID NO: 842 - DNA, 2646 bp, Homo sapiens
atttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatacaatgttaataattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaagatcgctcaggcccctctgtgtccactgtaactttcccagagtcggtcccaaagctcactggaccctctagatgttccctgtggccctgggggctccatggtcaaatatgtgagtgtcacatcctgtattttatgataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttcc

SEQ ID NO: 843 - DNA, 3636 bp, Homo sapiens
gggcggggcggggccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaggtga

SEQ ID NO: 844 - DNA, 2333 bp, Homo sapiens
gggactgtgttaagaaccaagggcatataaagacagatgggaggagaccctggccggggagaggaagaagcatctacataggtactaagtaccattcgctaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaa

SEQ ID NO: 845 - DNA, 2490 bp, Homo sapiens
gcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttag

SEQ ID NO: 846 - DNA, 3948 bp, Homo sapiens
aaactccacggtaacggggaccaatgttgttagaggttgaggttcctggtaggtcccaggtgctaaaaggaagagcagcctttgggatgtgagcccgaaaaccatcgtgttggcttctgaagccccaagatgggcatggcagggacgcggaagccctcagaaccgcggaagccctcagaaccgcacagcaggtggccgccgtggtgcagcgcgcagtcggccctcagctcccctgcaccggcgcgagctgcgggcgctgcccacgtcaggctctgcagacaccagacagaaaagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 847 - DNA, 5679 bp, Homo sapiens
agccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatctcaaagtctccttttagtctagataatcattatttcattttaaaattagtgtttttcctagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaaacaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaagtgaaattaagtagagtccccttttaaacaaatttgtctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtgtgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaa

SEQ ID NO: 848 - DNA, 3147 bp, Homo sapiens
acgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaa

SEQ ID NO: 849 - DNA, 650 bp, Homo sapiens
actgcgtgcctcccggcgctgtggggcggggtggggaggccacccccttgaattaagagggctctgccgcggccccagcagtgcggtgtccgtggaaggagactcagccctgcgatttcggaaaacccttgtttggcggggcgggaggggctgttgctgcgtggggtgagaagaaactaggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatacttta

SEQ ID NO: 850 - DNA, 560 bp, Homo sapiens
tccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcgattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaa

SEQ ID NO: 851 - DNA, 3353 bp, Homo sapiens
aaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactta

SEQ ID NO: 852 - DNA, 3351 bp, Homo sapiens
cttactgtcagaggttactacaagtgtttgaacaggtaacttctacctttgaacttctgttgtgacagattcaaaggttccaggggagtgtgttggccactctcaggacagtacacagtagcttcgggtgtgtcccagtcagtcctaggagctgtggaaagagtagaagtgcctgaatgtggtgctgaatcaatacagccagctgtgaggggagcacttcctggacccaggaagggagagtcttcttccaaggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagata

SEQ ID NO: 853 - DNA, 3353 bp, Homo sapiens
taaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactt

SEQ ID NO: 854 - DNA, 1583 bp, Homo sapiens
attggtgctgatagggaatgtagagaaaggcttcaccccgagcctgaaggtgatcatccttatggacccctttgatgatgacctgaagcaaagaggggagaagagtggaattgagatcttatccctatatgatgctgaggtagatgattttctagagaaatcttatgctcttccctggggcttccattgttcctgaatgttggcttctggtcctgatccagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctg

SEQ ID NO: 855 - DNA, 3380 bp, Homo sapiens
gccagaggatggaatgccacaggccccacttcgtctcccagcccttcatctttcttccatgtccaaaggcggctccccagaggccaagggctcagctcttgtgttctctgagactgtggcacagctcaccctggcttccttagtaggaagcttttaagaactgctctgtagaaagaacaaaccctaatctagctccagcaaagagccaggatcatgctgaacttcctgtgagccttcgtgggggatcgaggctggagaaagtgctgcttcattctgaggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactt

SEQ ID NO: 856 - DNA, 3281 bp, Homo sapiens
taaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactt

SEQ ID NO: 857 - DNA, 2561 bp, Homo sapiens
ggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataa

SEQ ID NO: 858 - DNA, 4499 bp, Homo sapiens
atgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctggctaatagaaattttttttttagagattttgctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattcatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtccaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtaatcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgaacctgggaggcggagcttgcagtgagccgagatcccgccactgtactccagcctgggcaacagaacgagactccgtctc

SEQ ID NO: 859 - DNA, 2548 bp, Homo sapiens
tccaggaagcatcattcccagagctgccagagcagtggccctggaaaatatggaagcagctgtcagccatggcccagggcctgagcgtatgattctcaggaaaagtgggcaggacatctgactgtcagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttc

SEQ ID NO: 860 - DNA, 2658 bp, Homo sapiens
ggctctaccaccacccggcttctcagagcaggcggctgttgccatcgactgtccccaggagggcagactcggggcagggccttcgccacttttgtgctttgatcaagatgtggtaacttctttccctgggccccacaggccctataaagggaggctggttctagtgggacgagctcagccgcctcctcagtgccaggagcctgctggaaagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaa

SEQ ID NO: 861 - DNA, 2622 bp, Homo sapiens
aaccgcgacccggctgccattcgagcctgcccagccataaaacccaggctgcgagtcgcgcgggggcagggtcgcgtgttgatggggtgggtggcggcggggtgggctcaatgtcacgctctggcgctcgtcgcccgtgctcccccttccagccggtttccgcagaatgccagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaaca

SEQ ID NO: 862 - DNA, 2148 bp, Homo sapiens
gggctgcggggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggacctaccacagtgcttaatacagattaaggtgttcagtaaatattga

SEQ ID NO: 863 - DNA, 6539 bp, Homo sapiens
cggcagcggcggcggcggcgcggctactgctggggctgctgggctgcggggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctggctaatagaaattttttttttagagattttgctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattcatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtccaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtaatcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgaacctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtattacctatcaaagaaccaataacctttcctttttctgcagtaaagaaaatgaaatatcctttattttccaaatgtatgaagcacaaatgcaatatagttatttaaaatataaaatactttaaaatgaatgtgaagaatgggaaaatatatttttgcatgaaaacagactacttacaaatgtgcttaatatctcaggaaaaaaagaatgaataaccgtatataaaattggtaaactataaattggctgtatttccttgccggttttaattttaaggaagcatttacatgaaaagaaaaaaggatcctagtagtctgaatttcctctcaagtatgctagaaaatactttctatgaatttacaattaactgcaataagaagtgggttagcattcaagtaaggtcaataccccaaatgagaaactcttcagttagaacacattagtggttgtaacacagaggcagtagataaatatttgaaatgtgagcatttctaaacttggtaccaaatggaaagggtttcatgaggtgacagtggcttttaaacattcatttgaccgattattctaattttccttgttaaatcattgcaacagttgcatgggggagaatggatattttttgaagaattgcttattccactttcaatttttaaaaatcgaggggattaaaatattactttttaaatatgcataaaagtatcttaactgtaattacattttcagttgctttgttatagtagcatgcatattaaatataaaatgcatttatgaaaatttttgtaaaaaataaaagatttttcatttctcaaa

SEQ ID NO: 864 - DNA, 4913 bp, Homo sapiens
gggctgcggggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagggctcagctgccaagaaggagcctctgcaacagcctccacacaggcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctggctaatagaaattttttttttagagattttgctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattcatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtccaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtaatcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgaacctgggaggcggagcttgcagtgagccgagatcccgccactgtactccagcctgggcaacagaacgagactccgtctc

SEQ ID NO: 865 - DNA, 2180 bp, Homo sapiens
gacaccgcggtcagtgcggggcaagccccagacccggccggccaggctgcagggcagggaagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtga

SEQ ID NO: 866 - DNA, 2490 bp, Homo sapiens
gctcgtcgcccgtgctcccccttccagccggtttccgcagaatgccagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaagg

SEQ ID NO: 867 - DNA, 2147 bp, Homo sapiens
agccatctcttcccaaggcaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgactacagttgtctaaagccaagggcattgtgaccatagatgcccttgcctcagaggtggactccatagcttctcagtgcccctctctgaaaaccaagctcctggtgtctgatcacagccgtgaagggtggctggacttccgatcgctggttaaatcagcatccccagaacacacctgtgttaagtcaaagaccttggacccaatggtcatcttcttcaccagtgggaccacaggcttccccaagatggcaaaacactcccatgggttggccttacaaccctccttcccaggaagtaggaaattacggagcctgaagacatctgatgtctcctggtgcctgtcggactcaggatggattgtggctaccatttggaccctggtagaaccatggacagcgggttgtacagtctttatccaccatctgccacagtttgacaccaaggtcatcatacagacattgttgaaataccccattaaccacttttggggggtatcatctatatatcgaatgattctgcagcaggatttcaccagcatcaggttccctgccctggagcactgctatactggcggggaggtcgtgttgcccaaggatcaggaggagtggaaaagacggacgggccttctgctctacgagaactatgggcagtcggaaacgggactaatttgtgccacctactggggaatgaagatcaagccgggtttcatggggaaggccactccaccctacgacgtccagtttcatatggaggcctcagttgaaaactgcattattgtgagcatgaacaccgctgaccctggcagccagggcatcacacacagcctcttgctacaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggtaagatggatgaagagggctacatttgtttcctggggaggagtgatgacatcattaatgcctctgggtatcgcatcgggcctgcagaggttgaaagcgctttggtggagcacccagcggtggcggagtcagccgtggtgggcagcccagacccgattcgaggggaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtgttgatttgggaaagtatcaggagtgccatgattccaatgttttccttcttttaaattaaattcagttgctctgcttcctccaagtcctctgtatctttagaatttcccaggtgagcactcataacgcaagtaataaaatactgatatcaac

SEQ ID NO: 868 - DNA, 2051 bp, Homo sapiens
agccatctcttcccaaggcaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgactacagttgtctaaagccaagggcattgtgaccatagatgcccttgcctcagaggtggactccatagcttctcagtgcccctctctgaaaaccaagctcctggtgtctgatcacagccgtgaagggtggctggacttccgatcgctggttaaatcagcatccccagaacacacctgtgttaagtcaaagaccttggacccaatggtcatcttcttcaccagtgggaccacaggcttccccaagatggcaaaacactcccatgggttggccttacaaccctccttcccaggaagtaggaaattacggagcctgaagacatctgatgtctcctggtgcctgtcggactcaggatggattgtggctaccatttggaccctggtagaaccatggacagcgggttgtacagtctttatccaccatctgccacagtttgacaccaaggtcatcatacagacattgttgaaataccccattaaccacttttggggggtatcatctatatatcgaatgattctgcagcaggatttcaccagcatcaggttccctgccctggagcactgctatactggcggggaggtcgtgttgcccaaggatcaggaggagtggaaaagacggacgggccttctgctctacgagaactatgggcagtcggaaacgggactaatttgtgccacctactggggaatgaagatcaagccgggtttcatggggaaggccactccaccctacgacgtccaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggtaagatggatgaagagggctacatttgtttcctggggaggagtgatgacatcattaatgcctctgggtatcgcatcgggcctgcagaggttgaaagcgctttggtggagcacccagcggtggcggagtcagccgtggtgggcagcccagacccgattcgaggggaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtgttgatttgggaaagtatcaggagtgccatgattccaatgttttccttcttttaaattaaattcagttgctctgcttcctccaagtcctctgtatctttagaatttcccaggtgagcactcataacgcaagtaataaaatactgatatcaac

SEQ ID NO: 869 - DNA, 1894 bp, Homo sapiens
aatcctgcggatcacctgatcagagagaactgaacctacaaaagagagctcaacctccttttccatacctaccagggacctagttcagctacgtcctaaacagtaccaggcaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgactacagttgtctaaagccaagggcattgtgaccatagatgcccttgcctcagaggtggactccatagcttctcagtgcccctctctgaaaaccaagctcctggtgtctgatcacagccgtgaagggtggctggacttccgatcgctggttaaatcagcatccccagaacacacctgtgttaagtcaaagaccttggacccaatggtcatcttcttcaccagtgggaccacaggcttccccaagatggcaaaacactcccatgggttggccttacaaccctccttcccaggaagtaggaaattacggagcctgaagacatctgatgtctcctggtgcctgtcggactcaggatggattgtggctaccatttggaccctggtagaaccatggacagcgggttgtacagtctttatccaccatctgccacagtttgacaccaaggtcatcatacagacattgttgaaataccccattaaccacttttggggggtatcatctatatatcgaatgattctgcagcaggatttcaccagcatcaggttccctgccctggagcactgctatactggcggggaggtcgtgttgcccaaggatcaggaggagtggaaaagacggacgggccttctgctctacgagaactatgggcagtcggaaacgggactaatttgtgccacctactggggaatgaagatcaagccgggtttcatggggaaggccactccaccctacgacgtccaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggtaagatggatgaagagggctacatttgtttcctggggaggagtgatgacatcattaatgcctctgggtatcgcatcgggcctgcagaggttgaaagcgctttggtggagcacccagcggtggcggagtcagccgtggtgggcagcccagacccgattcgaggggaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaa

SEQ ID NO: 870 - DNA, 701 bp, Homo sapiens
taacaaacaaatgaagaagcaaagaaaacaccctgggaggtcccccttcgctgtggccagaagccaagttctgctgggtgcacaatcctgcggatcacctgatcagagagaactgaacctacaaaagagagctcaacctccttttccatacctaccagggacctagttcagctacgtcctaaacagtaccaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgacta

SEQ ID NO: 871 - DNA, 2096 bp, Homo sapiens
gagttactgtgctctcttccaaggctgtaggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatatt

SEQ ID NO: 872 - DNA, 2734 bp, Homo sapiens
caggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagcagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaacc

SEQ ID NO: 873 - DNA, 1835 bp, Homo sapiens
gcttgagttactgtgctctcttccaaggctgtaggagttctggagctgctggctggagaggagggtggacgaagctctctctagaaagacatcctgagaggacttggcaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaag

SEQ ID NO: 874 - DNA, 741 bp, Homo sapiens
gagttactgtgctctcttccaaggctgtaggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaaatataaagtcagacacagagacgttaaataa

SEQ ID NO: 875 - DNA, 2748 bp, Homo sapiens
gagttactgtgctctcttccaaggctgtaggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagcagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaacc

SEQ ID NO: 876 - DNA, 2839 bp, Homo sapiens
gagttactgtgctctcttccaaggctgtaggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagcagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaa

SEQ ID NO: 877 - DNA, 2884 bp, Homo sapiens
ctctttccgacagtgcagggattctgaagctgtctgcttgagttactgtgctctcttccaaggctgtaggagttctggagctgctggctggagaggagggtggacgaagctctctccagaaagacatcctgagaggacttggcaggcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgaggcgtctaggagacattcatttggattcccctcttctttctctttcttttccctttgggcccttggccttactatgatgatatgagattctttatgaaagaacatgaatgtaagttttgtcttgccctggttattagcacaaaacattactatgttagatattgaaataagaaagggaaggaatgagagagagtgaaaaggagagggtaacagaaaaagaggaaagaaaagtaagtcagggaaatgttaaaaactgcaagagaaagcaattgaaaaagaaataaagtagggagggaaggcgagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtcatggaagacaggaagaaaggaagagagggaagtaaagaggaaaacctataaatattcccacagatagacaaagtcaagcataaaactggagcttgagaaggaaatgaaaggaaaagaagtggtactttcttttaccctaggagaagacctccatacaggaagacttgtgtgtggggctgggacattagaatcatccgcaagtcactccaaaccttgaaactgtcagggtcagaggggaaccaccatttattaagcatttgccatgtgccaggcactgacccagacacattataaataccacattgtttcacctgtgtgtggcatctacagaccttagatcatagctgtgagaacaaagtaagcactgccaaagttatcagctacccatacctcatgtttttggtgttatctactcttcctagaatcaaatattaaaataattttaaaaccaa

SEQ ID NO: 878 - DNA, 802 bp, Homo sapiens
actgtcaatgattagctgagctctctttccgacagtgcagggattctgaagctgtctgcttgagttactgtgctctcttccaaggctgtaggagttctggagctgctggctggagaggagggtggacgaagctctctccagaaagacatcctgagaggacttggcaggcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaaatataaagtgagacacagagaagttaaataa

SEQ ID NO: 879 - DNA, 2557 bp, Homo sapiens
cggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagaggatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagaggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaaga

SEQ ID NO: 880 - DNA, 1569 bp, Homo sapiens
cggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaaggtttgcacatccccttccaggagaatgtttaacaacccaatctgtacactacctacctaccgcttacccccatataaactttctttgttatgatggtgattccattttacttccatgatactttaatttttataaatatgtgaaaatgattagaaatg

SEQ ID NO: 881 - DNA, 1931 bp, Homo sapiens
ctatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaagtctttctctgtcacccaggctggagtacggtggctcgatcttggctcactgcaacctccacctccctggttcaagcgattctcagcctcctgagtagctgggattacagacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagaggatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagaggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctcc

SEQ ID NO: 882 - DNA, 2796 bp, Homo sapiens
gcatttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacgaagcacatacaactattttaatgaaaaagttatgttaaagaaagca

SEQ ID NO: 883 - DNA, 3680 bp, Homo sapiens
ggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttc

SEQ ID NO: 884 - DNA, 2244 bp, Homo sapiens
aaaaggaaaacgaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagtccctggttgcagatgccgtgtggcccataggccagcagcattcttctgccctggatcctcgggccccactggacaactgagcggccccccaggtggcccctgcacactggagtgtgcttggctctgaagacccaagctgctgcagctgcccctcgccacggtgggcccagctccatctgcctgcgaacaaagccccttctgagaaggaacttgaggctgctgcccctggagtagttcttcagtaaaagatgaaaaccctctgttgggggtcgggggctaaggagctaactggacacctggaggtccggcagggagggcccagccatggcactccccgaagggccagtttctctccatcagtctctcaggtgtgcctggaccctggggcaggcaggttgtgtgccacgccccctcggctggacgctgcccgtgggagcactgagtgtgtgctaagtagcggttcggtctgtgagcggggctggagccctgtggagacgtgtggttaaacataaaccatgtgagaattctcaggaccacagccagcctgtggaagctaaggacagcttcaggtccatgacactgaaatggccctggcaaagtacttattactctgtctctaaaaataaacaggggccggtcgcagtggctcatgccggtaatcccagcactttgggatggtgaggatcacttgaggacggtgggtggatcgcttgaggtcaggagtttgagaccaacctggccaacatggtgaaaccccgtctctactaaaaatacaaaaattagttgggtgtggtgatgtgcgcctgtagtcccagctacttgggaggctgaagcaggagaactgcttgaaactgggaggtggatgttgcagtgagccaagattgtgccactgcactccatcctgggtgacagagtcagactccatctcaaaaat

SEQ ID NO: 885 - DNA, 3857 bp, Homo sapiens
aaaaggaaaacgaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttc

SEQ ID NO: 886 - DNA, 2606 bp, Homo sapiens
aaaaggaaaacgaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatactccaaatagttgggttcttcagggaagctattagaaactcaggtgacttgttagagcactaa

SEQ ID NO: 887 - DNA, 4877 bp, Homo sapiens
agctatgcaaacacgctgcgagcggccttgagagcccgaggagggtctgctttctgggcccctgcagagggcaggggtcgcgggctggtggtctgccccgcccagagagaaagggccttggcttcccctcattcttcgttctgtgttagctctttttattgcaaataattaattaaagtcagtacagcaagagtgggaaagtggttaatgcaattgccaggtccagattcagagggatgaggcgccgaaaggaaagacaaccttgggatcgcttccacttcctccacttcgcaccgcatggccggcaagttggcggctctcgcctgctcccagttttcccggagttgagtatggttgactctgactggaccaggttgggtcacgtgtcggccctgagccaatcagcttgcccagagagatgatgcgccctgagtggtgggtgaacctggtgataggccccagagtggccagagaggaagggcatgcgcacaccatagacataggcaacgtggtggacgacatgggggctgggcgggggtgctgctcacccaccttgtgcccagtgctttcccttccccttgtccatggtcccctagcttggggagaaagcagggtgcttgctctacccgccagtgctgtctcggggctgcagggagttgtggctgccctgcttgcggtcttcactcccaactcactgtggctttgcagagctggagtccgccctatctgggcttgggggtctgctccctgagagcattatttggtgcccctcgactgtgttgattcagaaatctgggacctgttgtttctcgactaaatgtcttatgagatcagtctttcttttggaggcaaacattttcggaagttttggaaccatgatgatctatgcctcagacacttgtggtccctgagaagctgctgctggaaaaaggggtccccatccggatcccaggagagggttcttggatcatgccgggaaggaatccaaggcgagtggcagagcgcagtgaaaagagatagtttattgaaagcttctcagttacatagtagggcatcctcagcaagaggaggaatgcctctgttttgtttctttcttatataggggtcttatctatgtaaaagctaagctatgtctccctgcgggtaggctgacgaagtgacatttattactttgttgattgaaagaaagctatccttggcattttagtgcataagtacatcaaagcatgcctataatcatcttaaaagcatatattatgcaatattggggcatctggacattctgttgttgcaagagtttgtctttgcaggtattaagctacttcgtcagctgtaaacatcttatgactgtgggtcatgactggcaaggaatgtgccttgctagttttaagatggaattgattctaaaatggtgtcaccatggctcccctacgctcctgttcccctaaaaaaaccctgccgtaagcggacttaaggatagccttgtcaccctagcaatgtggcagtgaatctctgccaatagcaatctacaaatgttaaaaacttttctttttctggaaaagtactttccatgcattaagtattcaagtgcctgttttcctggcactgggctggatgtatatgacataaaatttgcagtattgctccacccccaaactgctctgcattttggccctcctccatctctgatggctttctcttccctgtgctgcagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttc

SEQ ID NO: 888 - DNA, 2228 bp, Homo sapiens
cctttccttgactaccctttgaacagaggagagctatgcaaacacgctgcgagcggccttgagagcccgaggagggtctgctttctgggcccctgcagagggcaggggtcgcgggctggtggtctgccccgcccagagagaaagggccttggcttcccctcattcttcgttctgtgttagctctttttattgcaaataattaattaaagtcagtacagcaagagtgggaaagtggttaatgcaattgccaggtccagattcagagggatgaggcgccgaaaggaaagacaaccttgggatcgcttccacttcctccacttcgcaccgcatggccgggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcct

SEQ ID NO: 889 - DNA, 2925 bp, Homo sapiens
aaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagggtaaactgaaagagaaatccaagcgtgttcagccccagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 890 - DNA, 2708 bp, Homo sapiens
atgatggtgaggtgggcacttctttgtgaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaagtgg

SEQ ID NO: 891 - DNA, 3065 bp, Homo sapiens
tatagtatttctgtccttgccaacctcgatccctccccaaccagacacggccccgccccctctggcaccgcccacccgccagactaagccactcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 892 - DNA, 2973 bp, Homo sapiens
actcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgagcactcttcatcctgtacaccagtggctccacaggcaaacccaagggtgtggttcacacagttgggggctacatgctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaagtgg

SEQ ID NO: 893 - DNA, 2400 bp, Homo sapiens
agtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctc

SEQ ID NO: 894 - DNA, 2851 bp, Homo sapiens
gaagggaggctgggctagatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtggtgagtgcagaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 895 - DNA, 4803 bp, Homo sapiens
ctttctttttacattttcccagtttcctcttttgattcatctttacttacttcctatttttgttttttgtttatttgtttgttttgttttctcattagaaaagccacagaaactccaagcaggcaaattagaagggaggcaatgcaacaagtcctatctgttctctgtctagatcacatgcggagtctggtcagcaggtgaatccgcatcccagtggggtcaccttccctgtgacctgtcaatcaccccaagaagcacttcccaatttgtctggcacaacctccttccactcctcctaccctctcagtggtcaggaaatcccggagcagtccttgccctggagctgcttgtgtttttagtaaccagggactgagctgattttgaaaaatcaatcaatcaataaataacaatcaaagagccttgcctcaacgcaccgagttgctggtttcctgcaggtcagaggcgatgccacctccaccaacgaccttccaaagattaaaccagccgtgtacaaactgctggattgaaaattgagagatgggccgttggcctcctcctaggagtacttgtgtgttgaaatcggaaggacgttctggagtttgagcgcgatttttcccggaaggctgcggggttggaagtgcatgttggggtttggatctcgtgcagcagcgcaactaacctgctgcaacggcgctgtgacacccctgtcccggggcccccactttagcctgttgcttctctggtcgctccaggtcggtttttcccggcgactctagtgtggcttccaaacttctgggctctgggctcacttcggaatttgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacattttctgagggaaagcagaacaccggggttatagctataccttcaggtcttttgttacttaggcaaggaaaaccacatgtctgacctggttcagcatgtaatccgagcactttgggaggctgaggcaggcggatcacttgaggtcagcagtttgagacgagcctggccaacatggtgaaaccctgtagctactgaaaatacaaaaataagccaggcgtggtggcgggaggctgaggcaaggagaatcacttgaatacaagaggcagaggttgcagtgagccaagttcccccactgtactccagcctgggtgacagagtaagactccatctcaaaacaacaaaaacaacaaaaaaaccacatgcctggcggagaacaaagagatcatttagtccaatctcttcatggagatgagggctcctgggagcccctcttcatgtctcaggttcttagttgactatgtttatccaaatgattccagattcctgtggaaacaaggaatcgatgtacaaatggggtagggtggcaaggaaaactcttaagagagaaacatcaaggttttcacattaggttaaagacaagaaggtttctaggcaggtagtgtaatgtctaggtgattttgaagtgaacttaagccactaggtttgagggacaaaggacagtagaaaatggtgaagactgcagatcacctgctatacctcaaggagcagcggacccagcagaatatggcccaaaaaggaggcaggtctcctgttgcaagagcctctgtttttttaaagagaaaacaaagaatcctggtttttatgtgaaatctctaattttaaaataataactcattaaaaatattgtaatgtccaaaagtatctttccatttaacttctaaaaatctcttaaatgttttttttaaataattgtaaagtgagtttttgttaagcttataggaatgggccagttaactaaggtagacagatgtaggaaattaaatatttgatttacttagggatctatatgacatcagttatcaaagaatacattttaacccaaaagtataccatgctcattgtatctttgatcgttcttcaagtatttctcaatcttttaatctatcaggaacattactatcaagagcagattgttgtaacataatactcaggatacatgaaatgtatgtgagagataaatagataatagaaagtttattgttataaaaatgacctacaacttatataaaaaaattctgaaaatgttgactttttttggactgaagactgcaaaataaatggcttctcaaa

SEQ ID NO: 896 - DNA, 2214 bp, Homo sapiens
caaattattttgtgttgactattgaaggacccaaagaaataatgattcaaagataattttataaaagccaaagtaacttgtagctaatatataaaatacttttgaccaggaacttttaaagtggatgctatgaagatagagagtgtttttacacattgtttattgattttaatttcactttttctctccttagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacattttctgagggaaagcagaacaccggggttatagctataccttcaggtcttttgttacttaggcaaggaaaaccacatgtctgacctggttcagcatgtaatccgagcactttgggaggctgaggcaggcggatcacttgaggtcagcagtttgagacgagcctggccaacatggtgaaaccctgtagctactgaaaatacaaaaataagccaggcgtggtggcgggaggctgaggcaaggagaatcacttgaatacaagaggcagaggttgcagtgagccaagttcccccactgtactccagcctgggtgacagagtaagactccatctcaaaacaac

SEQ ID NO: 897 - DNA, 1713 bp, Homo sapiens
gccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagt

SEQ ID NO: 898 - DNA, 3082 bp, Homo sapiens
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccgctatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggc

SEQ ID NO: 899 - DNA, 6369 bp, Homo sapiens
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttaaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcagaggtgggcgggtcttttgagttcaggagttcaagagcagcctggccaacatggtgaaaccccttctctactaaaaatatgaaaattatccgggcatggtggtgtgcctctgtactttcagctactcaggaagctgaggcacaagaattgctggaacatgggaggtggaggctgcagtgagctgagatcatgccactgcactccagcccaggcaatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtaatcacagctgcttgggaggctgaggcaggagaattggttgaacccaggaggcagaggttacagtgagcagagatcgtgccactgcattccagccggggtaagagagcgagactctgcctcaaaaaaagaaggcttagtgtgcaactcatcagagttgcacagggcagagaaagaatgggaaaaaaacaatttctagaaaacttttcgaattttctgatcaacaccaaatattccaaataggaaaaatacaaaaaaatccatacctatatgtggcataatatgattgtagagcaccaaagtaaaagatcttattttttattaaaattaaaaaaaaattaaaatagagggtctcactatgctgcccaggctggtcttgaactcctggcttcaagctatcctcccaccatggcatcctaaagtgctgggattgcaggcatgagctgctgcatctggcccaaagtaaaagatcttagaagcggccagaaaaaatagatttgggctgggcatgaatagattgatcaccaaaaaggtggcagactaacttctcgacagaatccacagaagccagaaggcagtggaacattagctttgatgtactaaaataaaataccacgctaggctcctacatacagtgaaaatgttttgagaatgagaattataattttttggcaaacaaaactaaaggagtttacaactaagaaactcttttgtgagacagccttgctctgttgcccaggctggagtgcagtgacgaaatctcagctcactgcaacctcggcctcccgggttcaggcaattcttgtgtctcagccttccaagtagctgggattacagatgtgcgccaccaggcccagctactttttatatttttagtggagatggggtttcactgtgttggccaggctggtctcaaactcctgacttcaagtgatctgcccgccttggcctgctaaagtgctgggattacaggcatgagcgactgtgcctctccagtccctgtgtttttttttgtttttggaggttttatttgtttgtttttagagacactttcactgtgttgcccaggcctgtctgttggcctcaagtgatcctcctgccttggatctcccaaagtgctgggattacaggtgtgaaccactgtgctcagcccattttttatttgtttcttgaaggaaggtagcagtattaattaattttggactttgctcactaaagtttgaatgttaagaatagatgtatacagtctggatgcagtggtgcatgcttgtaattttagcactttgggaggctgaagcgggaggatcgcttgggctcaagagtttgagaccagcctgggcaacatggtgaaaccttgtctctacaaaaaaattttaaaaaattagccagacatgatggcatgcacctataatcccagctacttgggaggctgaggtgggaggattgcttgagtccagggaggtcgaggctgcagtgagccatgatcacaccactgcactccagcctgggtgacagagtgatactgtctc

SEQ ID NO: 900 - DNA, 2086 bp, Homo sapiens
gccgcaggcgtagcgctctcgccctggccatggagcggccggcgcccggcgaggtggtcatgagccaagccatccagccggcgcacgccactgcgcgcggcgagctgagcgcggggcagctgctcaagtggatcgacaccaccgcctgcctggcggctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaagaaaagattcatttaaaaccagtcacacttctaactgaacaagatcatgtggaacataatctggctgctgagagaaggaaagttcgattacaacatgaagatacctttaacaatttaatgaaggaaagtagcaaatttgatgatctcatttttgatgaagaggaaggagcggtttccacaaggggcacctccgttcagagcattgaactggtcctcccaccccatgcaaaccatcacggaaatacatttggtggccagattatggcgtggatggagacagtggctactatttctgcaagccgcctgtgttgggctcatccctttctgaagtccgtagatatgtttaagttccggggaccatctacagttggagatcgtcttgtcttcactgccattgtcaacaatacatttcagacctgtgttgaagttggagttcgcgtggaggcctttgactgtcaggaatgggccgagggccgagggcgtcacatcaacagtgcttttctcatttacaatgctgctgatgataaggaaaatctcatcacgtttcccagaatccaacccatttcaaaggatgatttcagacgctatcggggagctattgcacgcaagcgaattcgcctaggcagaaaatatgttatttcccacaaagaagaggttccactttgcatacactgggatatcagcaagcaggcatccctgagtgacagcaatgtggaggccctcaaaaaactggcagccaaaaggggttgggaggttaccagcactgtggaaaagataaaaatatatactctggaagagcatgatgttttatctgtttgggttgaaaagcacgtgggaagtccagcacatttggcttatcgtctcttgtctgactttacaaagcgacctttgtgggacccccattttgtgtcctgtgaagtcatagactgggtgagtgaagatgatcagctgtatcacatcacctgtcctatactgaatgatgacaaacccaaagacttggtagtactcgtatcacgaagaaaacccctcaaagatggtaacacttacacagtggcagtgaagtcggtcattttgccatcggtccccccgtctccacagtacatcagaagtgaaatcatatgtgccggatttctcatccatgctattgacagcaattcatgcatcgtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaaaggtcaactttcaattactggtaatttaatttcccacttttaattccaagcacccttagccctgacatctgtcaagctttggggccacaaaataatttaatataaccctaagcaaaatgcagtgacggagttaaaaaacaaaatgcatcttaagtcaaataccagtgatttggattagcattaaaagagctttagaattctgttgtaagtcatctgtggctctgcctcttccaggggcacagatagtggaaaattgcctgtatgcagtactatgtgttctataaaatggcatgaatttagtttaaattatcgtaaacatttttaggttacagaggtgaaacatgcattctgtgtgaaattccaaaaaaaaaattataaaatctaaaatg

SEQ ID NO: 901 - DNA, 1774 bp, Homo sapiens
aaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagt

SEQ ID NO: 902 - DNA, 2362 bp, Homo sapiens
ttgggcgccacaccttgcgcgccccggggcccaaggagacgaccctgaagaggagcctggctacttttgcctcagacgagtccggagcgccgggttaaccggtctgaagtcccaggggctttctgggactgctcagccaccggcagcttccggcaccaggggacgccggacgccgtccggacattcggcgcgcttgccacgatcttggacgggtctcgggcctcgacctttgaattccccgctccggctccaagatgtcagcaacgctgatcctggagcccccaggccgctgctgctggaacgagccggtgcgcattgccgtgcgcggcctggccccggagcagcgggttacgctgcgcgcgtccctgcgcgacgagaagggcgcgctcttccgggcccacgcgcgctactgcgccgacgcccgcggcgagctggacctggagcgcgcacccgcgctgggcggcagcttcgcgggactcgagcccatggggctgctctgggccctggaacccgagaagcctttttggcgcttcctgaagcgggacgtacagattccttttgtcgtggagttggaggtgctggacggccacgaccccgagcctggacggctgctgtgccaggcgcagcacgagcgccacttcctcccgccaggggtgcggcgccagtcggtgcgagcgggccgggtgcgcgccacgctcttcctgccgccaggacctggacccttcccagggatcattgacatctttggtattggagggggcctcttggaatatcgagccagcctccttgctggccatggctttgccacgttggctctagcttattataactttgaagatctccccaataacatggacaacatatccctggagtacttcgaagaagccgtatgctacatgcttcaacatccccaggtaaaaggcccaggcattgggcttttgggcatttctctaggagctgatatttgtctctcaatggcctcattcttgaagaatgtctcagccacagtttccatcaatggatctgggatcagtgggaacacagccatcaactataagcacagtagcattccaccattgggctatgacctgaggagaatcaaggtagctttctcaggcctcgtggacattgtggatataaggaatgctctcgtaggagggtacaagaaccccagcatgattccaatagagaaggcccaggggcccatcctgctcattgttggtcaggatgaccataactggagaagtgagttgtatgcccaaacagtctctgaacggttacaggcccatggaaaggaaaaaccccagatcatctgttaccctgggactgggcattacatcgagcctccttacttccccctgtgcccagcttcccttcacagattactgaacaaacatgttatatggggtggggagcccagggctcattctaaggcccaggaagatgcctggaagcaaattctagccttcttctgcaaacacctgggaggtacccagaaaacagctgtccctaaattgtaatgcatttgtctgttgttgacatgagagattcaagatcagattctagtgttcagtaaccctatgtgaatcagatgtctcctggataacattaaagccatgtctttgtcattaatggtgtattttacgtaactttgttgaataagctttgtcgttagttttactaatgtaacttgcttgttgtagaagattaagaggcatatgacacatataagtgaaaaacattcccaccagttaacatttgtgtttccttctagatttttttagttaatgttttgagtcacaggtgagctttaaagctggtgactttttccatcactatgaaagaatggtcacttaatgtttgctgttcaaccatcagtagcagggtagaattttctttggccagaaacatacagaggggtgttaatatgaggaaaggcagctgaccttttcattataaacgtgagagaagactcttttgacaggaggagatgagacctgtctctagaatagttaagtctgtactctcttccaagggtgaattactacgatctattttccctctcacttcctctctaagagcagaccctggggccgagtacagtggctcacacctgtaatcccagtactttgggaagtcaaggggggcatattgcttgagctcaggatttcatgaccagcttaggcaacatggcaaaacccaatccctacaaaaattagccaaacatggtacacacctgtagtcccagctactcgagactcagatgggacgattgcttgagcccgggaggtcaagattggtgcagtgagccgtgattgcaccactgcactccagcccaggtaacacagcgagaccccgtttc

SEQ ID NO: 903 - DNA, 1004 bp, Homo sapiens
tatattatcattattgtttgagaaaataagacattttgttctttctctgccaatctctctacccccaatctccttggcttcaaaaacttgtttgcttactgtcttttgagaaactaaagctccctgtgatttgtgatgttctccaggcagggggccctttcctgggatcattgatctgtttgggagcagcaggggcctttgtgaatacagggccagcctcctggccggacatggttttgctgtgcttgccctggcttatttcagatttgaagacctccccgaagatctgaatgatgtacatctggagtactttgaagaagccgtggactttatgctgcagcatccaaaggtgaaaggtcctagtattgcgcttcttggattttccaaaggaggtgacctgtgtctctcaatggcttctttcttgaagggcatcacagccactgtacttatcaatgcctgtgtagccaacacagtagctcctctacattacaaggatatgattattcctaaacttgtcgatgatctaggaaaagtaaaaatcactaagtcaggatttctcacttttatggacacttggagcaatccactggaggaacacaatcaccaaagtcttgttccattggaaaaggcgcaggtgcccttcttgtttattgttggcatggatgatcaaagctggaagagtgaattctatgctcagatagcctctgaaaggctacaagctcatgggaaagaaagaccccagataatctgttacccagaaactggtcactgtattgacccaccttattttcctccttctagagcttctgtgcacgctgttttgggtgaggcaatattctatggaggtgagccaaaggctcactcaaaggcacaggtagatgcctggcagcaaattcaaactttcttccataaacatctcaatggtaaaaaatctgtcaagcacagcaaaatataacattgtagccacagaccagataccattaataaaaatcctattcatacaa

SEQ ID NO: 904 - DNA, 870 bp, Homo sapiens
acacacatgagattccatcacccaggcagcattcctgagccttgggggactggtttccaatgattcttaggcttctgtcattctttgctgcctatctgctgagagtgccacttgcttactgccagaactctgtatgcatacaacccaaaatggactctgccagtgattagatttgtgaggcagggggccctttcctgggatcattgatctgtttgggagcagcaggggcctttgtgaatacagggccagcctcctggccggacatggttttgctgtgcttgccctggcttatttcagatttgaagacctccccgaagatctgaatgatgtacatctggagtactttgaagaagccgtggactttatgctgcagcatccaaaggtgaaaggtcctagtattgcgcttcttggattttccaaaggaggtgacctgtgtctctcaatggcttctttcttgaagggcatcacagccactgtacttatcaatgcctgtgtagccaacacagtagctcctctacattacaaggatatgattattcctaaacttgtcgatgatctaggaaaagtaaaaatcactaagtcaggatttctcacttttatggacacttggagcaatccactggaggaacacaatcaccaaagtcttgttccattggaaaaggcgcaggtgcccttcttgtttattgttggcatggatgatcaaagctggaagagtgaattctatgctcagatagcctctgaaaggctacaagctcatgggaaagaaagaccccagataatctgttacccagaaactggtcactgtattgacccaccttattttcctccttctagagcttctgtgcacgctgttttgggtgaggcaatatt

SEQ ID NO: 905 - DNA, 2429 bp, Homo sapiens
gccggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 906 - DNA, 1813 bp, Homo sapiens
aggatgcaggcttggacctgctggagtccttgctggcctgtgaccttcctcccctgtctacatttcagggagctctagaaggcggcagtggggccagacctggctttggctgagaccctggagaaagactagggggtcttgtgccctgtcagagaaggcagagcctcatagccgcttccctgaggccgctcagcagcggcccctctgccttcctgatctcctggcatggcagccagaagagctcacagaattacttcttctgtaattatttataaagcaaggtttccatgacgaccggtttctggtagacgctctggattggcgaggcagcctcttcctggccagattgggcagctcaggaagctgggggtggggggtgctccccaccaagcccggtgtggcagggagctgggacagtcctgggtcaggcaaggactctgtgatgcttccctgctccctcgcctttctctgcatctgatcctgggatgtcctagccaccatggctttccagctgagcaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 907 - DNA, 1432 bp, Homo sapiens
gagttccatttggctgcagcttctggagggagccgacaggagacgtggggagacgatgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 908 - DNA, 1614 bp, Homo sapiens
cggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 909 - DNA, 1474 bp, Homo sapiens
agttccatttggctgcagcttctggagggagccgacaggagacgtggggagacgatgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggaggagttgactttcactgaaaaatgcaaaagagggcacagttactcttttccaattccgtgaccttgtttggccggagcccccactgctacgtgggacacaacacaccagaccctcagtgttggggcaaggaaggaaaaaggtggacgaagagctgttccctactcttgaggaacttctggtctagggggatcaagaggtgaacaaacaaatgctttgggacgccgctttcttcctcgtgaagctgagtggcacaggctgcagttaaattccttctagtactcgccttctaggatcttggtgtttgaaaacatcgttctccaggttcttctgttctgaagaacagcttcacgtccatcctgatgcttcagcgggggagcgggacgtggggactggtgaacttgaaccttgaaccccgagatggtgtcaaccctgaaagcctgggcgtggggttcatatcactccagtccaagcatcctataggcacctgtcccaggaactcactttgtcctgcccacactgggtcctcctctcagccgggtccctggtggccagcacgtcatccctctcaaatcatggggcactgacccctttccagaaatatggagtatttggttgaggtcttgccatgaaccgtaagaacgtcctctccctctccccctccccctccccctctccccacggtctccctctccctctcttgccacggtctccctctgatgccgagccgaagctggactgtgctgctgccatcttggctcactgcaa

SEQ ID NO: 910 - DNA, 1294 bp, Homo sapiens
cattccgcgccgggcctgccagacacctgcgcccttctgcagccgcccgccgcatccgccgccgcagcccccagcatgtcgggcccagacgtcgagacgccgtccgccatccagatctgagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 911 - DNA, 1168 bp, Homo sapiens
tactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgataccactgga

SEQ ID NO: 912 - DNA, 423 bp, Homo sapiens
atctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcagagcagatgccctcatgtgttctgcgtagatccccagctgagaagagtttgtggacctttacagtatgtgatttgtattaa

SEQ ID NO: 913 - DNA, 1675 bp, Homo sapiens
gctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaa

SEQ ID NO: 914 - DNA, 2768 bp, Homo sapiens
aagagcagtaacacaaacagggctgaaacacgccctcctcccgtccccacacccccgcgacttgccatgttgcgggtgatgtgaaggagagaagtgctgtggcccttcagggagcacagacctaggggctccctgagccagggctgtgacaccctctttggggctctgcggtttctggtatcttcaaacttccgggcaccactgcattccccttgtccagacacaggtgcccacagcagaagccgcttgtggttcatcagatccagctgcagacttgcatagaaccggcacctttgccggcgcctggagctgcctgcccagctgcagcagctggtgtgtccggctctgcgcagtggccagaccctgcgttcgctcgcctgcacacccctcgctgttccgtgcctggctcaccctcggcaggcgtggaatcctggctggtagcatgagctgagcacagcctgccaggccacgtcagtggaacaagtctggcgggcctgatcaaaactcaggcaaaggcaccactggtcacagagctttctagctggaaaagcaacacctgaaggatcccgtgacacaatcaacctgctaggagatccctgccaccctgagaggctgcaggaagctgcctccatccaggcctcttcacagaaggagaattgcagagaccgtaggatttttctactcacaggaacagatggtgtccggtcaggaaggtaaaatgcttcaagaaaagtgcaatagggattataatactgatgatctgagactctgataatgactctgagatgattcccaattctatgatgaatcatctcagaatgactccgagatgatgattcctgattctacgatgattgaggcagagctcactggttggtgaatctagttggtagagctgaggcaccgcaataccatcatttctttctgaggaaatctaaagatgaaagaattcatcactaaaactgtactacgagaaatgctaaaggaagttgttcaaactgatggaaaattataccagatggacacttgaatttgcccaaaggaatgaagagcaccagaaatggcaaatgtgtggtcttactgtatcttcatgtcagtgtcatatcaaggacaagacagcagaaatggtccactccagttgcagatagtaaagaccctgtagctccagcatcagctcacctttctggttttgaatttcatgcttattaccatcctgtcatcacctactgtttccatggtagacgggactaagagatgggctttgtgccttgggcaaagggcagcttactcctggaagaggactgactcaaggaccccagaaccccaagaaacagggaatcttccacattcatgaagttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttc

SEQ ID NO: 915 - DNA, 3117 bp, Homo sapiens
gtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgagaggctgggcgtggtggctcatgcctataatcccagcactttgggaggctgaggcgggcggatcatgaagtcaggagatcaagaccatcctggccaacatggtgaaaccctgtctctactaaaaatacagaaaattagccgtggtggcatgtgcctgtagtcccagctacttgggaggctgaggcaggagaattgcttgaacccaggaggtggaggttgcagtgagctgagattgcaccattgcactccagcctgggcgacagagagagactgtctcaaaaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggatatatctgatttaaaaaataggaaccacaataataatagctgcttatgcttatggagcattgccatgtgctagataggcaccatcctcagcccttggcaggtctgagctcctttatttcttccaatcaacactatgaggcaggttctgtaaccccccttagggttaggccactcgggaaactgaagcacagagagtttaagtaacttcctggaggtccgacgcgtaacatgtggaggtgctgggattcaaaaccaggcaatgtgggtcccgggcactcttgaccagtgcctgtacttcttccaaggaatagagcaagggaggtcataccgaatatcacagtgtcacctaggaagcccaagggaggtattcccgttaatctgcagccaaggccgggcgcggtagctcatgcctgtaatcccagcactttgggaggccaaggcggatggatcatgaggtcaggagttcaagaccagcctggccgagatggtgaaaccccgtttctactaaaaatacaaaaattagccgggcgtggtggcggacgcctgtaatcccagctactcgggaggctgaggcagagaactgcttgaacctgggaggcagaggttgcagtgagctgtgatcatgccactgcactccagcctgggtgacagaacgagactccatctcaaaaaaaaaaaaaaaaaaa

SEQ ID NO: 916 - DNA, 3849 bp, Homo sapiens
atgaaaggaagagtgagccaataaacgagggaacgccgggaaaggcagcctcaagccggtgggccctgccacccccaccgtccctgagcatccgagccggttcccgcccccggcccgaactggcccgcgcgcgctcgcagccccgcggcggaacccgagggcggcggcagcggtttcccttgaacgagccggggaatctggagggagcacacaggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcaaattggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaa

SEQ ID NO: 917 - DNA, 245 bp, Homo sapiens
ggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcagcactatcaggatgaatcacgctgggagccaactctgagtagaactccaggaagttaa

SEQ ID NO: 918 - DNA, 1046 bp, Homo sapiens
caaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcagcactatcaggatgaatcacgctgggagccaactctgagtagaactccaggaagttaaccatctggtgaagagcagttctgacgcccacccctatagactgtttgtttctggattggtcccaagaacacagaactggactggtagaagctctgggaatttgtttgtgtctgcagttgtctttgtagatttgtctaacccctgaatcatccctgatctgaataacccccaaggatatcagttcagagcaagtgttacctctaaaagtcaaatcttcttaaaattgttgattcatatttttaaagctcatctccaagttcaactgatccatatcatgtacactgttatattccatgagattttacttaaatattcatttatatggctaattatagctggattataatatttgtcctttcaaatataagacagcatttttgcccccccactgcaaaaatgtgcattataccttgcagatgaaattctgagactgagttgcctttttgttttatatcatttgagcttatgatgtcagaaataccaaaatagaaacatgaaaatcaaaagtggcaaatgtgtgaagcatttagtaataaaaataggtggcagacctcatgtttgtttctgaaatgttttaatggatgacagtgagaatagatactataaattaattcctctctttagcgattgttacaatagatactataaattaattcctctctttagcagttgttacagtatatactataattcctctttttagcgattgttatctagctgttctaaacctgtgttttacgaatttgattacttctttgtttaaatgtattatctttcatatggctctaagttgttttggaaatcaattcaaataaactttaatattaaattaaa

SEQ ID NO: 919 - DNA, 976 bp, Homo sapiens
agagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaagggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaagccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtct

SEQ ID NO: 920 - DNA, 2379 bp, Homo sapiens
acagatcagttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaccctatgggggctgccacgtcacaggcccaaaggactcttcttcagcagcatctttgcaaatgtctttctctcaatgaagagcatatctggacgactgtgcaatgctgtgtgctcccgggatcagtaacccttccgctgttcctgaaataacctttcataaagtgctttgggtgccattccaaa

SEQ ID NO: 921 - DNA, 2334 bp, Homo sapiens
aacagatcagttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaccctatgggggctgccacgtcacaggcccaaaggactcttcttcagcagcatctttgcaaatgtctttctctcaatgaagagcatatctggacgactgtgcaatgctgtgtgctcccgggatcagtaacccttccgctgttcctgaaataacctttcataaagtgctttgggtgccattccaaacaagagagtatctgtgccctttacagctaattgttctaaaaggagtttct

SEQ ID NO: 922 - DNA, 1352 bp, Homo sapiens
acaagagctgagcggaagccaggtcaagggtggtgctgatcattgtgacttccctgatgaagttgaagaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaccctatgggggctgccacgtcacaggcccaaaggactcttcttcagcagcatctttgcaaatgtctttctctcaatgaagagcatatctggacgactgtgcaatgctgtgtgctcccgggatcagtaacccttccgctgttcctgaaataacctttcataaagtgctttgggtgccattccaaacaagagagtatctgtgccctttacagctaattgttctaaaaggagtttctaaaaacacttaagtccagcgatgttcagcaatttacccagggtcttggcatgccaggggactgatcccccctgtgttgctgacttctttaaaatggccggg

SEQ ID NO: 923 - DNA, 2462 bp, Homo sapiens
aacagatcagttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgagagaaagagcatcctcctcaaaggcatattaatgacaagccagacactggacaaccaagaatggacccagctaacatcatggataaagggaaacctgacatgcgacagcagaaccagagagtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaactatgggggctgccacgtcacaggcccaaaggactcttcttcagcagcatctttaaatgtctttctctcaatgaagagcatatctggacgactgtgcaatgctgtgtgctcccgggatcagtaacccttccgctgttcctgaaataa

SEQ ID NO: 924 - DNA, 2396 bp, Homo sapiens
tttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgagagaaagagcatcctcctcaaaggcatattaatgacaagccagacactggacaaccaagaatggacccagctaacatcatggataaagggaaacctgacatgcgacagcagaaccagagagtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaccctatgggggctgccacgtcacaggcccaaaggactcttcttcagcagcatctttgcaaatgtctttctctcaatgaagagcatatctggacgactgtgcaatgctgtgtgctcccgggatcagtaacccttccgctgttcctgaaataacctttcataaagtgctttgggtgccattcc

SEQ ID NO: 925 - DNA, 627 bp, Homo sapiens
actaaacttccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacttttaaaaaa

SEQ ID NO: 926 - DNA, 650 bp, Homo sapiens
ggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 927 - DNA, 565 bp, Homo sapiens
tttgcgcgccttggtgagccgttggcgtggtggtcccggagtgatcctggcagccggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 928 - DNA, 993 bp, Homo sapiens
cggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaa

SEQ ID NO: 929 - DNA, 1913 bp, Homo sapiens
attaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgctggagtgcagtggtctgatctagactcactgcagccttgaccttctgggctcaagtgatcttcccacgtcaacctcctgagtgcacatgctggctaatttgtgtgtgtgtgtgtgtgtgtgtgtgtgtatattttgttgttgttgttgttgttgttgttgttgttgctttgtagagatagtgtctcactatgttgctcaggctggtataggactcttggcttcaaatgactttcctgcctcagcctcccaaagtgctgggattacaaaaataaactttatttttgagaacagttttatatttacagaaaaattgtgaagatagtacagagactttccatatactccccacacagttttcctcctattaacattttacattaatatgatacgtatgttaacaattaatggaccaatatggatacattagtattaactaaaatccctatttatttagatttcaatttttacctaatgtccattttatgtcttaggatcccattattgtatttgctttttaattgggcattctcttgaaattaagagaagtgacattttggctgggtgcagtggctcatgcctgtaatcccagcacttcgggaggctgaggcgggcggatcacttgaggtcaggagttcaagaccagcctgtccaacacagcgagatcgtgtctctacaaaaaatacaaaaactagctggggttggtggcacacgcctgttgtcccagctacttgggaggctgaggcaagagaatcgcttgagtctgggaggcagaggttgcaatgagatgagattgcaccaccgcactccagtctgggcaatgggagtagcctgtcccaaaaaaaataaaataaaataaaaataaagacagaagtgacatttttatgatattaaatcttcccatttaagaacacacagatgttgttccatttgcttagattttaaaatttatccttcagtatgattttatggttttctttatataggtttttgtacttttcttgctaagttatttctaagtatcttaatgactttttcactattgcatatggatttctttcccatttatgcttctagttgttcatgcttaaatatggaatatctaatgacttttgtgtattaattagatatcatagtattaccttatcagatattcttattaattctatcagttttttaaaaaactatagtctattgggtttttaaaaaatacagttatgcaattagtaaaaatggtgtatctttgtttcagtgacttcatttgtcagacctgccatgacaatgttgaataataatagccatagcaggcatgcctgtttggtttctgactttatttaaaatagttttattgtttcacctagtaaaaagatgtttgctgttggttttaggtaaatatactttatcacaataaattttacttttgcattccttg

SEQ ID NO: 930 - DNA, 5034 bp, Homo sapiens
gcggcggcaggcctagcagcacgggaaccgtcccccgcgcgcatgcgcgcgcccctgaagcgcctgggggacgggtaggggcgggaggtaggggcgcggctccgcgtgccagttgggtgcccgcgcgtcacgtggtgaggaaggaggcggaggtctgagtttcgaaggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaa

SEQ ID NO: 931 - DNA, 1523 bp, Homo sapiens
gaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctcc

SEQ ID NO: 932 - DNA, 4402 bp, Homo sapiens
atgaggctgctgcggcgctgggcgttcgcggctctgctgctgtcgctgctccccacgcccggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctggctcccagctgtctgtatcctcctgccccgccctggcgagtgcctaccctggcagaacccagggaggagtggaggctgcctctgcctgggcctccacacagcatcctgtacatacgccacctgggctgggggtggggaggcagggccaggagcatcgattaaagatcacatcctggggcttccagggagctcacaccaa

SEQ ID NO: 933 - DNA, 2876 bp, Homo sapiens
tgctgggggtctggccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcagccccaacagggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttcccccttt

SEQ ID NO: 934 - DNA, 2529 bp, Homo sapiens
gctgctgcagccaccttttcctgcagtgctcggggtgacagccggtccggagcgcgggagggtaggggagcgggagaggagggaaggtgcgtccacccacctgtccccagctggccgggcccaccgcgtccctgcccctgccgccgaccggccagctctgcaggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaac

SEQ ID NO: 935 - DNA, 3313 bp, Homo sapiens
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtaattctgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcctccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcaatgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 936 - DNA, 7938 bp, Homo sapiens
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtaattctgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaatctcagttgattttctggattccccatctcaggccagagccaaggggcttcaggtccaggctgtgtttggctttcagggaggccctgtgccccttgacaactggcaggcaggctcccagggacacctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacatttcacagcgtggatttttccagcttacacatgtgggatgacatcacagaaaccacaaaagcagcaaattaaactgtaggagagtcaatactcctgacgagtctcggggggggggcatttttatgccttcttaactttatgagaattctcaggctgaactataggccattgttcccaggcaaatcaatacatcaatgcatcctcaaaaaaaaaaaaaaaaaaaaaaaaccggctaaaactgtgtcaaaatgttcttaaggagcctatggtctccacggtgctaaaaagagcctggtgctgggccgactggcagggctgagcatcctcctgccccctcgccactgatgtttactaagcactctgagccaatgagacccccagcagcagaaagggcacaaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttcctgtaactctttaaaacttggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaatatcaatgtg

SEQ ID NO: 937 - DNA, 1145 bp, Homo sapiens
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcacca

SEQ ID NO: 938 - DNA, 2799 bp, Homo sapiens
ccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgtt

SEQ ID NO: 939 - DNA, 2877 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 940 - DNA, 2949 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 941 - DNA, 2874 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 942 - DNA, 2732 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 943 - DNA, 1938 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaataggagcttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttc

SEQ ID NO: 944 - DNA, 2946 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 945 - DNA, 2804 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacaggctagtgctctcagcttcccggcccccccttccaggccgctgccgcctgaccctgtgtccaagagactccagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 946 - DNA, 2678 bp, Homo sapiens
acttgctgccctcgcccggcccggagcgccgctgccatgcggctggcgctgctctgggccctggggctcctgggcgcgggcagccctctgccttcctggccgctcccaaatatagtactgtcttggggtgtcctgggacctgcaggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgta

SEQ ID NO: 947 - DNA, 6481 bp, Homo sapiens
agacgcgcctccaccgccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 948 - DNA, 6472 bp, Homo sapiens
gccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaatctctagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 949 - DNA, 2782 bp, Homo sapiens
gccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccagaagtgccttttgcctcctgccatgattctgagggctccccagccaagtggaactgttgtttgcttagtaattagttttaatatggccttctacaggtcaatgaggattagaatagaaccaggaatcaagaccaagttgctggttttactagtttggaagcagttttaa

SEQ ID NO: 950 - DNA, 3312 bp, Homo sapiens
tggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaa

SEQ ID NO: 951 - DNA, 2672 bp, Homo sapiens
gcctacctcttccaggctgcgtggccggggcgtcatctcgcgcttccaactgccctgtaaccaccaactgccattattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaa

SEQ ID NO: 952 - DNA, 2535 bp, Homo sapiens
ggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaa

SEQ ID NO: 953 - DNA, 2792 bp, Homo sapiens
gggagttcagcagtgtgtttaagactagggtcatgcccacatcaatctcagattcccattttatctttcttttttggtatcactcctagtaccaagtcttgtgtctgtcaatatcctgtccaaaaaagaaaaacacaccaaggaaaattaatataggaaaaatttaaaaagttattagaggactgaaaatataaaaatggaacactgaaagacacagagtttttattttcagcactgcagctctgatggtccagctccaccaggacacagatccccagatccctaaaggtcagccatgcaccctgaacagctcagagggaggagccagaccagcagtgcctcacaccttgttctcttctgctctagacagatggctccataatgacagcttcataatggcagtgggtgagcccctggtgcacatcagggtcactcttctgctgctctggtttgggatgtttttgtctatttctggccactctcaggccaggccctcccagtatttcacttctccagaagtggtgatccctttgaaggtgatcagcaggggcagaggtgcaaaggctcctggatggctctcctatagcctgcggtttgggggacagagatacattgtccacatgagggtaaataagctgttgtttgctgcacaccttcctgtgttcacctacacagagcagcatgccctgctccaggatcagcccttcatccaggatgactgctactaccatggttatgtggagggggtccctgagtccttggttgcccttagtacctgttctgggggctttcttggaatgctacagataaatgaccttgtttatgaaatcaagccaattagtgtttctgccacatttgaacacctagtatataagatagacagtgatgatacacagtttccacctatgagatgtgggttaacagaagagaaaatagcacaccagatggagttgcaattgtcatataatttcactctgaagcaaagttcttttgtgggctggtggacccatcagcggtttgttgagctggtagtggtcgtggataatattagatatcttttctctcaaagtaatgcaacaacagtgcagcatgaagtatttaacgttgtcaatatagtggattccttctatcatcctttggaggttgatgtaattttgactggaattgatatatggactgcatcaaatccacttcctaccagtggagacctagataatgttttagaggacttttctatttggaagaattataaccttaataatcgactacaacatgatgttgcacatcttttcataaaagacacacaaggcatgaagcttggtgttgcctatgttaaaggaatatgccagaatccttttaatactggagttgatgtttttgaagacaacaggttggtcgtttttgcaattactttgggccacgagcttggtcataatttgggtatgcaacatgacacccagtggtgtgtgtgcgagctacagtggtgcataatgcatgcctatagaaaggtgacaactaaatttagcaactgcagttatgcccaatattgggacagtactatcagtagtggattatgtattcaaccgcctccatatccagggaatatatttagactgaagtactgtgggaatctagtggttgaagaaggggaggaatgtgactgtggaaccatacggcagtgtgcaaaagatccctgttgtctgttaaactgtactctacatcctggggctgcttgtgcttttggaatatgttgcaaagactgcaaatttctgccatcaggaactttatgtagacaacaagttggtgaatgtgaccttccagagtggtgcaatgggacatcccatcaatgcccagatgatgtgtatgtgcaggacgggatctcctgtaatgtgaatgccttctgctatgaaaagacgtgtaataaccatgatatacaatgtaaagagatttttggccaagatgcaaggagtgcatctcagagttgctaccaagaaatcaacacccaaggaaaccgtttcggtcactgtggtattgtaggcacaacatatgtaaaatgttggacccctgatatcatgtgtgggagggttcagtgtgaaaatgtgggagtaattcccaatctgatagagcattctacagtgcagcagtttcacctcaatgacaccacttgctggggcactgattatcatttagggatggctatacctgatattggtgaggtgaaagatggcacagtatgtggtccagaaaagatctgcatccgtaagaagtgtgccagtatggttcatctgtcacaagcctgtcagcctaagacctgcaacatgaggggaatctgcaacaacaaacaacactgtcactgcaaccatgaatgggcacccccatactgcaaggacaaaggctatggaggtagtgctgatagtggcccacctcctaagaacaacatggaaggattaaatgtgatgggaaagttgcgttacctgtcactattgtgccttcttcctttggttgcttttttattattttgcttacatgtgctttttaagaaacgcacaaaaagtaaagaagatgaagaaggataagagaaatgggaaaaagaaggagactaaactttatacttcatttttaatatccaattttttaatagaaaaatatgaagccatgtctcactgtttaaataaaacttcatggacatttcatgtcaggattgcaagcattagctatcacagcaaaggattcctagcctattcttacttactctacagtgtcttaagcaatattaaaggttccttttccca

SEQ ID NO: 954 - DNA, 2406 bp, Homo sapiens
atggcagtggatgggaccctcgtgtacatcagagtcactcttctgctgctctggcttggggtatttttgtctatttccggctactgtcaggctgggccctcccagcatttcacttccccggaagtggtgatccccttgaaggtgatcagcaggggcagaagtgcaaaggctcctggatggctctcctatagtctgcggtttgggggccagaaacacgttgttcatatgagggtcaagaagctcttagtttctagacacctcccagtgttcacctacacagatgaccgtgcactcctggaggatcagctcttcatcccagatgactgttactatcatggttacgtggaggcagcccctgagtctctggttgtgttcagtgcttgttttgggggctttcgaggagtattaaaaataagtggcctcacttatgaaattgaacccatcaggcactctgccacatttgaacacctggtttataagataaacagtaatgagacacaattcccagctatgagatgtggcttaacagagaaggaagtagcacgccaacagttggaatttgaagaggctgagaactcagctctggaaccaaaatctgctggtgactggtggactcatgcatggtttctggagctagttgttgtggtgaaccatgatttcttcatttactctcaaagcaacatctcaaaggtgcaagaggatgtatttcttgttgtcaacatagtggattccatgtataagcagttaggtacttacataattttgattggaattgaaatttggaatcaaggaaatgttttcccaatgacaagcatagaacaggtcctgaacgatttctctcaatggaaacaaatcagtctttcccagctacagcatgatgctgcacatatgttcataaaaaattcacttataagtatacttggcctagcctatgttgcaggaatatgtcgtccacctattgattgtggagttgataattttcaaggagatacctggtctctttttgccaacactgtggcccatgagttaggtcatacgttaggtatgcagcatgatgaagaattctgtttttgtggggaaagaggttgcatcatgaatacttttagagtgccagcagagaaattcaccaattgcagttacgctgattttatgaagaccaccttaaaccagggatcatgtctgcataatcctccaagattgggggaaatctttatgctaaagcgctgtgggaatggtgtggttgaaagagaagagcagtgtgactgtggatccgtacagcagtgtgaacaagacgcctgttgtctgttgaactgcactctaaggcctggggctgcctgtgcttttgggctttgttgcaaagactgcaagttcatgccatcaggggaactctgtagacaagaggtcaatgaatgtgaccttccagaatggtgcaatggaacatctcatcagtgtccagaagatagatatgtgcaggacgggatcccctgtagtgacagtgcctactgctatcaaaagaggtgtaataaccatgaccagcattgcagggagatttttggtaaagatgcaaaaagtgcatctcagaattgctataaagaaatcaattctcagggaaaccgttttggtcactgtggtataaatggcacaacatacctaaaatgtcatatctctgatgtcttttgtgggagagttcaatgtgagaatgtgagagacattcctcttctccaagatcattttactttgcagcacactcatatcaatggtgtcacctgctggggtattgactatcatttaaggatgaacatatctgacattggtgaagtgaaagatggtactgtgtgtggcccaggaaagatctgcatccataagaagtgtgtcagtctgtctgtcttgtcacatgtctgccttcctgagacctgcaatatgaaggggatctgcaataacaaacatcactgccactgtggctatgggtggtccccaccctactgccagcacagaggctatgggggcagtattgacagtggcccagcatctgcaaagagaggagtttttttgccgctgattgtgattccttctttgtctgttttgactttcctgtttactgtcgggcttcttatgtatctacgacaatgttctggtcccaaagaaactaaggctcattcatcaggttaagaaaatgtctctaacttaatattccatgcattagtacactttagtctcttggcagtagaaacattagtacatccctgaaactgagcacatttctgaccatttccagaaagctgcaaagatcttcccttacattagtaccacaaacattgtcattaagttcaagttattcttaacatgtttctatctattgtttattgttttaagcagcaaataaagctacatccttccctcccttta

SEQ ID NO: 955 - DNA, 2891 bp, Homo sapiens
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgct

SEQ ID NO: 956 - DNA, 3420 bp, Homo sapiens
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataacaatattttcaatttcaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaatttt

SEQ ID NO: 957 - DNA, 2784 bp, Homo sapiens
gccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtaagtctgaacctctaatggaaaaaggcactccaaggtcctgtgcaaatagtgtcaaaagtaaattaagcagatagtcaaagaactgt

SEQ ID NO: 958 - DNA, 9334 bp, Homo sapiens
cgggcgctcgctccctgccgagctcttgtcgcccgcccgagcctttgccaggggatgaggtgggaggcgctagaaaccacttagctacagccaaccgcccaatgcagcactcgctcgctccccccgccagcggaagcgtccgcgaagcacaatgcagcactgagccgcggtggaggttgcagcgccacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctgtgaaatgaatgacttgttttaacaaaaacaactttgacactgttgattaagaatatttgtcatcactgggatgtgaatcccaacaagtcattctgcactgactctgaagcaagatgacggaagattctactgtttgagttgagcagcttcaaccattcataaagggttaagttagatctaaaccacagagatgcagcatctgcgaagttacactaacagctggtgggggaaagaatctgatgctttgaaacatatatttttaatccataggaaaataagattctattttaaaagacccttctttaaaaccaaagtttgatagctgttataatggcagatctgtcattccaaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgactaaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttttcatccaccgaggtaggtagcattaaatatacaagcacagcattatttctctttaaatatctattttggagagaaactttgaggccgtatcacagtttatatcatgcaactaatatttatatttcccaatccactacaaaatcattgctaagcagaagagagcagttatttggcctttatgttccattgtatgcctttttcccctcttccagttttatgcattgataagactacagattggcaccctgctgcctgagaagttccatttatccatagtcattgcagtgcagtaaaccctgatttaaaggaacatttaagtctctccagtaagtgtgaacaggaaggcatgggatagaagagagtccttatggagtggactggccacatgaactgtcctccagccactctttatttagatgggaagtggcatggtcctctgaacgctgcaggctggaaatgatccccagggcacatgcaatctgtggaaaggaatacatcggacagtgcaacatggtgagggctttcaatttgctgtggttgctgtatttttaacaagacacccggagcttcgattaggaataacctatcattagagttgttcctttaaaaaatgttgatgaataaagcaaatgtgggtttaaaatgccaacttatttttcactttgatattggtgctttattaagtgataccatagtttctctctcttttccctgttactttaaaaagaattttaaaattgtgtttgtatataaggtcagtctggcatagaatttctgaaagtaacattaataggatttctaaagaagttgtcagaaagacaaaattggatattctctgcactttcagagaaggactatttatgtttgaatttcataacaggcttacatttcttttctattgattcccttgcatatctacataatttaatcctgtctattgtcccagatctcttgtggctactttacctgttaccttttttgggattttgttctttatgttttacagttaccttcggaccagaagatatatggtatttttattcacttttttcagtgttttaaaataaggtttgttcatttattcattttatccattcatttcctattgtcgtatagttctaaccatatatatagtactttaaatattttcttatgttattatttaacacaataataaattcttatctaaagaaaagattattttactttattttacttaaaggaaagagaatttattggcaggatattgagtagcttgtagagtatatggaaggggagagccaagttaggaactggcaggagcgaggagggacaagacagctgcctgcacagtctgataggacacatctggctgctgccactggatgcccacatgggcagcgtgttgtaaatatcaccctaccagttggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctttatcttcacccactggcacattagcagcttatgcaacttaggaagtcactgggagatgagtcctaaaagcctgaatttcaggatggggaggagataagaagcagagaactttgggagaccatggggcatttagtcctggcatagacacagaatggatattcacaggaagattcctgaggccagatatgcaggagagcacacattgtcacaaggggtgtggtgggaagagaggtgctggatgcctaagacagacttctgtgcttggcagattgactgagtgttgactctgaatactttgtggtccagtccataataggccagtcactcctgcctgatgcatccctgttgcactgttcataaaacctgtatcatatggggaagcttcaaggctggcaggcttttcatcaagtaatcatcattccatgttcctacgtatccttgaaatcaaaaccaggcaatatgtgtgtttttggttttgttttacaaaaaggcatacaatgagacgaattcttaagataatgcacatacagaatcatcaataaagtttcaaagagtttatgaagaaaaggtattttcctttcttgtaaaaaatgttatatatatataatattctgatctgcattcaccttagggcttagcctcttattttatgaattttcaggctgtgatttgtgttggatggctaagctctaaaataatgcaaatagccccaatctttaaatatagcggtgctaagttgaacaagtaacacaatacagaaaatgctgatatgaatacttagtaataatacaaaagttcctgctaaattatatatgtgtatcactgcctgactagaaaccccacttttcttttctaatccagcacaaaatcaaactctgattctacaaccagtctttttaaagggcaaaaatgactcaacacctttgttttgtatggaaaacttttttttttacactaactgcaaaactgctttaaaaaaaggcttattcaggatagataagcatgtactccttttttaacttgctggaagacttgcccctccaaactagcacccccaaaagacaacttctttcagaaacggggtgttttacctaaacatagtagcttacatgttagccagcagtaggtcggcactagtgttttccacggttatcacctttgacaggtgatgtgcatctatagatagtggaagccaccccatgaggaggtgttaatagcagcatggtttcacttttggtaatcaggtaatcatgtgtatatacttagattcgcattattttaacatttctctgctactctgcacttcaggttcgttaagctattttaataattactggggttatggcaaacaccaatggaaatgtatatggcaactgctttcctgagcaagtgtgatttgttttatggctgttcaagttataaaattgttcttacattgtaggtaaacaaaatcttgatgtttttaaaggtcactgtaacttaaggttcaaatttctggcacagttttattagtattcacttcggaagctaataagataccatggttttctatgttactcccattgtaacattagtaaagtgactttcaataaaagatttatgttattttga

SEQ ID NO: 959 - DNA, 9144 bp, Homo sapiens
catgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctgtgaaatgaatgacttgttttaacaaaaacaactttgacactgttgattaagaatatttgtcatcactgggatgtgaatcccaacaagtcattctgcactgactctgaagcaagatgacggaagattctactgtttgagttgagcagcttcaaccattcataaagggttaagttagatctaaaccacagagatgcagcatctgcgaagttacactaacagctggtgggggaaagaatctgatgctttgaaacatatatttttaatccataggaaaataagattctattttaaaagacccttctttaaaaccaaagtttgatagctgttataatggcagatctgtcattccaaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgactaaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttttcatccaccgaggtaggtagcattaaatatacaagcacagcattatttctctttaaatatctattttggagagaaactttgaggccgtatcacagtttatatcatgcaactaatatttatatttcccaatccactacaaaatcattgctaagcagaagagagcagttatttggcctttatgttccattgtatgcctttttcccctcttccagttttatgcattgataagactacagattggcaccctgctgcctgagaagttccatttatccatagtcattgcagtgcagtaaaccctgatttaaaggaacatttaagtctctccagtaagtgtgaacaggaaggcatgggatagaagagagtccttatggagtggactggccacatgaactgtcctccagccactctttatttagatgggaagtggcatggtcctctgaacgctgcaggctggaaatgatccccagggcacatgcaatctgtggaaaggaatacatcggacagtgcaacatggtgagggctttcaatttgctgtggttgctgtatttttaacaagacacccggagcttcgattaggaataacctatcattagagttgttcctttaaaaaatgttgatgaataaagcaaatgtgggtttaaaatgccaacttatttttcactttgatattggtgctttattaagtgataccatagtttctctctcttttccctgttactttaaaaagaattttaaaattgtgtttgtatataaggtcagtctggcatagaatttctgaaagtaacattaataggatttctaaagaagttgtcagaaagacaaaattggatattctctgcactttcagagaaggactatttatgtttgaatttcataacaggcttacatttcttttctattgattcccttgcatatctacataatttaatcctgtctattgtcccagatctcttgtggctactttacctgttaccttttttgggattttgttctttatgttttacagttaccttcggaccagaagatatatggtatttttattcacttttttcagtgttttaaaataaggtttgttcatttattcattttatccattcatttcctattgtcgtatagttctaaccatatatatagtactttaaatattttcttatgttattatttaacacaataataaattcttatctaaagaaaagattattttactttattttacttaaaggaaagagaatttattggcaggatattgagtagcttgtagagtatatggaaggggagagccaagttaggaactggcaggagcgaggagggacaagacagctgcctgcacagtctgataggacacatctggctgctgccactggatgcccacatgggcagcgtgttgtaaatatcaccctaccagttggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctttatcttcacccactggcacattagcagcttatgcaacttaggaagtcactgggagatgagtcctaaaagcctgaatttcaggatggggaggagataagaagcagagaactttgggagaccatggggcatttagtcctggcatagacacagaatggatattcacaggaagattcctgaggccagatatgcaggagagcacacattgtcacaaggggtgtggtgggaagagaggtgctggatgcctaagacagacttctgtgcttggcagattgactgagtgttgactctgaatactttgtggtccagtccataataggccagtcactcctgcctgatgcatccctgttgcactgttcataaaacctgtatcatatggggaagcttcaaggctggcaggcttttcatcaagtaatcatcattccatgttcctacgtatccttgaaatcaaaaccaggcaatatgtgtgtttttggttttgttttacaaaaaggcatacaatgagacgaattcttaagataatgcacatacagaatcatcaataaagtttcaaagagtttatgaagaaaaggtattttcctttcttgtaaaaaatgttatatatatataatattctgatctgcattcaccttagggcttagcctcttattttatgaattttcaggctgtgatttgtgttggatggctaagctctaaaataatgcaaatagccccaatctttaaatatagcggtgctaagttgaacaagtaacacaatacagaaaatgctgatatgaatacttagtaataatacaaaagttcctgctaaattatatatgtgtatcactgcctgactagaaaccccacttttcttttctaatccagcacaaaatcaaactctgattctacaaccagtctttttaaagggcaaaaatgactcaacacctttgttttgtatggaaaacttttttttttacactaactgcaaaactgctttaaaaaaaggcttattcaggatagataagcatgtactccttttttaacttgctggaagacttgcccctccaaactagcacccccaaaagacaacttctttcagaaacggggtgttttacctaaacatagtagcttacatgttagccagcagtaggtcggcactagtgttttccacggttatcacctttgacaggtgatgtgcatctatagatagtggaagccaccccatgaggaggtgttaatagcagcatggtttcacttttggtaatcaggtaatcatgtgtatatacttagattcgcattattttaacatttctctgctactctgcacttcaggttcgttaagctattttaataattactggggttatggcaaacaccaatggaaatgtatatggcaactgctttcctgagcaagtgtgatttgttttatggctgttcaagttataaaattgttcttacattgtaggtaaacaaaatcttgatgtttttaaaggtcactgtaacttaaggttcaaatttctggcacagttttattagtattcacttcggaagctaataagataccatggttttctatgttactcccattgtaacattagtaaagtgactttcaataaaagatttatgttattttga

SEQ ID NO: 960 - DNA, 7052 bp, Homo sapiens
gaatgaaccagggagtttcattctgtctcactggagaggaggcagggacagacccagcagcacccacctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatctaagtgcaaaggacatgctgtgtgtgaccatgagctccagtgtcaatgtgaggaaggatggatccctcccgactgcgatgactcctcagtggtcttccacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccagtgtctacacctaaggactcaaatccaaaagcatgaagcaacagctaagcaagaactaatggctaaattatcaacttggaaaactggaaaatctggatggcagagaaatatactatctatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgtttgcactgcaaatatatttggtctgaatgatattgatattggacacatagtacttttacatgttttgaatgtattgctaatatttaaaaattgagagatcttgcataaacaatagattcccagctttgtcagatgtaatctaaaagtaatccgatgctttgtcaacaacagacttacattgcccatagcaaccgtcagcttagttgatgggtaatgtagcaaacactattggtttcctaccaaataatcccctttttcctggcttttagaacaataattttgttcacctgcccacttctaggaaagaatatcctatctaatctatctatctcagggataaatccctatccttttaagtaagtcaagtcaattaaaataacctcatttttccttgctagtggtcgacttggagatgattttataatcctccccctccctttttttttttgctagtaagacgacagaggaattatgttacaacacttctggaaaatttttcctcgtctctttttctggatatgggcatctgaatactctagctggtactgctgcgctccacacggtgattatgaaggctgaaaaagatagatagagcagaaagatgaaaagaataaaacctggcctttcaatgatgtcatggaattggtagatcagtgactgctggagttacctcacactttcttggtactccttattatatgagccatacattttccttgttgtttaagccattttgaattggattttctctcactttcaacagagatcatcctaactagtaaagtagctgtttccataatcagggaacatgctttagttcatcatcacagctacagtttttcttgtatttgtctgcttcacccatttctatcaatcacttacctggtccccacaggcctgtcgcttcatgaggaactttatggttcatttacccttgcagtatgaggttctagataagcccactctggcctcaaaagtgaagctcagtcctcaggaaatccagagtccactgatcaaatcactgtcaaggatacaggctttttctccatgtggcatttgcagaagaacaactttaaaagtagagctttatctgccctgtgaggtttcagaagaccctcccctgacccagaaataaatccctatttcctggaaagccattatgtactcgtgaccaacttgtgaacttttctgtgttgttgttgttgttttttaaatatctgtccccagtaatagattcacctaatccttttttatactgatggaatggaaatcttaaatctatgaatcctcaactagccatgtaccataacccaagcaaaaactaaaccatacactctcaaaagcagtggcatgtgaacatgcctgcaagttcctaaatgatgtcactaggtccctgatgcagatgcatcatacgtcctatttgaagagaagaaatgcagtacaatgacaggaaaaccattattttatcatagaactgcgaacccaagtcctacaatgtttccctttcagctcaactgcagaatagtttagaacagactttttgatttcacaatactgtttccacacttacttatatccgtaactttctaactttaagggaattccgcttatttgacatttaactacctcagatatgccaccaaacctgttttcatcattagttatttttaccttgtctactttaaaacagtgaaattattaggttaaattatgtttttatccagttactctaagataccttagtgtttgtctacttattacaactcaccaaattactggttttatatggcctttgggaaggcttttagctttttataaaataatgaagtatgcatgaaaagaaagcaaattttagttggttgcagtcagagaatatggaaagggttattattataattaggattttattattcacattggaaatcactgctatgtgttaaggaattgaaggtggcctctggctagcagccattaagaaaatgagcccctgagttcaacgaccctcaaatgaagtgaagtctaccaataaccactgaataagcttggaattttagattccttcccagctgaatcttgacttcagccttgtgagacaccctgaagtagaggatgcagctaaattttgtccagattacacacccacagaaactgtatgataattaatatgtgttgtttaaagttgttatggtttggagatatttgttatgcagcaatagatagctgatacaaggaagtagagaacaaacattttctattagtctgttttcacatggctataaagaataccacctgagactgggtaatttataaagaaaggaggattaattgactcagatttccacatggcctaggaggcctcaggaaacttacaatcatgatgaaagaggaagcagaaacatctcatatgatggaagatgtgtatgaaggaggaactgtcaaacacttataaaaccatcagatctcttgagagcttactatctcgacaaaagcatgggggaaaccacccccatgatccaatcacctcccacctggtccctccctcaacatgtggagattatagcaattaaaaaaatgagatttggggggatggacacagagccaaaccatataatgttttaaatgctccagataggtttaggtaaaattaactatatttaataggctttcatcactgcaaaactttttttcctttctttgtgtctctagtctcttccatttgttctcccttctttactagcaccgaggatttgcttgaaatctctgatagccagtattctcatttatcatattctttctcactttgtgtttccttggtaattttggataactccttaaatttatcttccaaattactggtttttatattctgtactgtcagtcctcctgttcactaatttcaaaatttatagttgtttctcttgtttacttatatagttgtttctcttgtttacttaataacattctcttctttcctatcagtttaattttataaaggctaaccaattaactgtttttaacttatatttccagatattttaaaaattaaagcaaaatgtgtataaactttattactgcttcccacagtaaatatttttcagaagtacatgctttctcagccacttgactagtatgttccccatcattcaaagacaccattatttcctaagtgttatattgctatttttcagttggtgcatccaatattattatcagctttaatattgtttcatcatatgtcattgttcaaagaatccatctcttgagcgtaagctaaataatttgcatacactagcatctggatgtaatatggaaaaatatggaaatggttggggtgataagcaagtcttgcatattcttttctcctcaattttttttctccaaagtgggccaagccaagagtggcacagctgtgtggagatactgagctccaccttgtcagggaagatcccaactcaggagaaaacacctctaacaaaatctgtagccacgttggcacatctgcccttgaattcactttgtctcttttgctgcttccataaaaaggctttcccttgacaatgttaggcactttttagcaactaggcctgggtggtctgctacaatgcccaacacttaatacagtatcactattactgttagtagtatgctaagcgaatactattgttataaaaaaaatcctaagcatgaaaattacggtatacaatttattgtgaaggcaacttcttgtgaacattaaacggtttatctccttcacctcatattaaagtccatactcttgggatatatctgacatctcaatattaaatgactaagatgactaagtcgtttatgttgctcccacctcacacaaagttaaaactatttgttactttaaatagtttgacaatgttattttaaaatctggacaaatcacaaatataaaatacttatttaatttt

SEQ ID NO: 961 - DNA, 2543 bp, Homo sapiens
actggagaggaggcagggacagacccagcagcacccacctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagttttaaacagtttgctgggagatgtcactgggtttttcaatgaacgcacatgaagcatggaagcaaagtcaagacatttgagaccaatgtggctgactggctcccaaaggatgaccacaacttttgctacatagctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatctaagtgcaaaggacatgctgtgtgtgaccatgagctccagtgtcaatgtgaggaaggatggatccctcccgactgcgatgactcctcagtggtcttccgtagacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccagtgtctacacctaaggactcaaatccaaaagcatgaagcaacagctaagcaagaactaatggctaaattatcaacttggaaaactggaaaatctggatggcaga

SEQ ID NO: 962 - DNA, 2085 bp, Homo sapiens
gcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggtaggaggacaaatcctttcccctgtgcatgtgcgaaggaaaatcatttcagatgacagtgtttaaccatggtcaaaggaccattctgtcctatccttcttagaagctttgaactcaaaatcatggaaaggttttaagatttgaggttggttttagggttgctagatttagcaagtaaaaataaggatggccccgttaaattttaacttaaaattaacaagttttttgttaattttttgttttttgtctcagcatcagtatatcccatgcaatatttgaggtgtgctcatactaaaattatttgtgtatctgaaattcaaattaaactgggtgtctttttcttttcatctggcaaccctactaagatcataaacccttggaaatctgtgtgtgtgcgggtgtgtgtgtgtgtgtgtgtgcaggggtggcagaagtactgtgggatgggacagaaataagaaaagatggaaaaaagaaaa

SEQ ID NO: 963 - DNA, 1873 bp, Homo sapiens
actggagaggaggcagggacagacccagcagcacccacctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaagaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggtaggaggacaaatcctttcccctgtgcatgtgcgaaggaaaatcatttcagatgacagtgtttaaccatggtcaaaggaccattctgtcctatccttcttagaagctttgaactcaaaatcatggaaaggttttaagatttgaggttggttttagggttgctagatttagcaagtaaaaataaggatggccccgttaaattttaacttaaaattaacaagttttttgttaattttttgttttttgtctcagcatcagtatatcccatgcaatatttgaggtgtgctcatactaaaattatttgtgtatctgaaattcaaattaaactgggtgtctttttcttttcatctggcaaccctactaagatcataaacccttggaaatctgtgtgtgtgcgggtgtgtgtgtgtgtgtgtgt

SEQ ID NO: 964 - DNA, 3325 bp, Homo sapiens
gtgacatcacatccactaaccaaatggggtggtgtgagtatctcctataaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagta

SEQ ID NO: 965 - DNA, 3152 bp, Homo sapiens
aaaataaaagctctcctgatggcctgttcctgcacatttcctgaggacgccctcgatcacaagcaggttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacatt

SEQ ID NO: 966 - DNA, 3244 bp, Homo sapiens
gtgacatcacatccactaaccaaatggggtggtgtgagtatctcctataaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagta

SEQ ID NO: 967 - DNA, 788 bp, Homo sapiens
actaaccaaatggggtggtgtgagtatctcctataaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccaga

SEQ ID NO: 968 - DNA, 555 bp, Homo sapiens
acatccactaaccaaatggggtggtgtgagtatctcctataaaataaaagctctcctgatggcctgttcctgcacatttcctgaggacgccctcgatcacaagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatcct

SEQ ID NO: 969 - DNA, 632 bp, Homo sapiens
gtgacatcacatccactaaccaaatggggtggtgtgagtatctcctataaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgt

SEQ ID NO: 970 - DNA, 3010 bp, Homo sapiens
aaaagctctcctgatggcctgttcctgcacatttcctgaggacgccctcgatcacaagcaggttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagt

SEQ ID NO: 971 - DNA, 2963 bp, Homo sapiens
agaccgagccctgggaggctacgggctcccccggaaaccctgccaggggagccgggttttgagctcaggcgcctctagcggcggcccccagaaatctgactcgcgaggccagagttgcagggactgaatagcaaactgaggctgagtagggaacagaccatgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaaaactggacaggaagaatctaaagcaaacattgaaagtaaacgacccaaagcaaagagtgtcaagaaacaaaaaaagtaaccgggcaatccatactcattcagtaacacaggctcatttatttaaccagctaatcatttatccaaaggctttccattcttctcccaatatttttttactttaatttttcccacaagttttgatcagcaaataaacagcattcttgttttggaaacaaaccagtgcattctacttctcgagtgttcacttgcccctcagtttgtgaccaagttgtgggtattctgagaatcatgctctaatggcttttccatacactaaagctctgaaagtagtgagtttcctagaattaccatgctattcaaggtatagtcttgtttctcagaatcccagggaacaaagcaattgtctgcctctccctctgcctccctcaacttgatccatgtgaacatccgcacctgcacccatgctgatcaataaatgccgacaacaca

SEQ ID NO: 972 - DNA, 2346 bp, Homo sapiens
atgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaacattgaaagtaaacgacccaaagcaaagagtgtcaagaaacaaaaaaagtaa

SEQ ID NO: 973 - DNA, 542 bp, Homo sapiens
cagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccagctgctggccccaggatacatagaaacccactacggcccagatgggcagccagtggtgctggcccccaaccacacggtgagatgcttccatgggctctgggatgcaccgccagagggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccaggtggtgaactctgcgggagatgctcatgga

SEQ ID NO: 974 - DNA, 380 bp, Homo sapiens
gagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccagctgctggccccaggatacatagaaacccactacggcccagcccaggagtgccgcgacctctgctgctttgctcacaac

SEQ ID NO: 975 - DNA, 3452 bp, Homo sapiens
cggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacat

SEQ ID NO: 976 - DNA, 3677 bp, Homo sapiens
gggcggcggtccgggagtggcgacccggctcccccatggcgcgcgccgtcggggcccctggccaggctccgagcggggttggcggggaggggaggcgggagcgagggcgggcggtgggaggtgggggcgggaaggtccgaaggcggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatatta

SEQ ID NO: 977 - DNA, 1971 bp, Homo sapiens
gagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggtgagatgcttccatgggctctgggatgcaccgccagaggtacccccccaccattcctacccctactcctccttgcattcctaaggggcggttggagccagcccctaccacaccctccctcttgcccctcttgctccagccctggctgagatttggggctggccccttcctccctaggatcattgccactaccaagggcgagtaaggggcttccccgactcctgggtagtcctctgcacctgctctgggatgaggtgagctctgggagaggaggctgggcctgggatggggaaagagctccctcacacccgctcctacccctctgcaccctagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcagggtcaggggcatcgatcggatgggagtgggaatgctgtatctatagccctccaaatcagaagagacgggaattcacaggcctcgagtcccagtatttttattgaagtctgaagaaacaagttccagaaaacatgttaaacttccttctgggagctgggattggtggtcagggctcaagcccagcagcttccacgagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagg

SEQ ID NO: 978 - DNA, 2619 bp, Homo sapiens
cagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccagctgctggccccaggatacatagaaacccactacggcccagatgggcagccagtggtgctggcccccaaccacacggtgagatgcttccatgggctctgggatgcaccgccagagggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaatttt

SEQ ID NO: 979 - DNA, 3674 bp, Homo sapiens
gggcggcggtccgggagtggcgacccggctcccccatggcgcgcgccgtcggggcccctggccaggctccgagcggggttggcggggaggggaggcgggagcgagggcgggcggtgggaggtgggggcgggaaggtccgaaggcggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatatta

SEQ ID NO: 980 - DNA, 2078 bp, Homo sapiens
cggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccaggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacat

SEQ ID NO: 981 - DNA, 2507 bp, Homo sapiens
gagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagg

SEQ ID NO: 982 - DNA, 3029 bp, Homo sapiens
agctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggtgagatgcttccatgggctctgggatgcaccgccagaggatcattgccactaccaagggcgagtaaggggcttccccgactcctgggtagtcctctgcacctgctctgggatgagggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtgggtaggctccgagcgcctgcttcctgagcctactcctgcggttcccctcctcagagctctgctggggctgtgggagctggggcaggccctcagccttgcccccaggtgcagagagcagccccagaggccatggaaagaagtagctttgaacaggaggttccagtggcctcccagtcaagcgagggggtggatccctgccccaccaccagcaccgcaaggcatggccctctacctcccagagatgggggcagagggcataacagacaggggcagggcaccacctgggccccgggtggcagctaagaggaccctgacaaagcgagttgtgattgagggtctgtgggcagaggagcaaggtggccagagcctggcgtgtcagcacggagggggcgctgcagagggtggcggctgcttctcatccccaggcgggagtctcagggcaggggagaatgttttgaaggaacatcacaggaaatgacaaggccttgggggatgggatggggacagtcaaagatggcttggaatcatcaagggcagcagggcacccaggggcaaggagagcagacatagctgccgaaggggcggacatccaaggttctttggaagctgagcgatgccagcatctggagagtgccaggctgctgtcagagcctggaggaaatgttaggactagagagaggaggtgccagccgagggcatgaggctcacttggagcctggatcccaaggctcccctgaagagggagcaggaagggagctgagagggtgacttggagcagatgggtgccccaagaaactcagtaaacgcagaactccctgggctggacaccatgctgcggggaggcaataacccactcaggatcactgtgccaacctcctggactcttatcacgttgctcagccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacag

SEQ ID NO: 983 - DNA, 812 bp, Homo sapiens
gctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccagtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcct

SEQ ID NO: 984 - DNA, 3367 bp, Homo sapiens
atccctgcagtggaagtgaggaggaagaaaggtgaactccttttctcaagcacttctgctctcctctaccagaatcactcagaatgcttcccgggtgtatattcttgatgattttactcattcctcaggttaaagaaaagttcatccttggagtagagggtcaacaactggttcgtcctaaaaagcttcctctgatacagaagcgagatactggacacacccatgatgatgacatactgaaaacgtatgaagaagaattgttgtatgaaataaaactaaatagaaaaaccttagtccttcatcttctaagatccagggagttcctaggctcaaattacagtgaaacattctactccatgaaaggagaagcgttcaccaggcatcctcagatcatggatcattgtttttaccaaggatccatagtacacgaatatgattcagctgccagtatcagtacgtgtaatggtctaaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaaggcatccatgatgaaaagtatgttgaattgttcattgttgctgatgatactgtgtatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgaggcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtgagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcagaaaaaaaatgtcttgtggtctttcaaatgctctttagcacaatataaaaattcgtaaccttgctgtagtattttcctacaaaatgttactctgctttcttttaagaatccaaactttaaggatgataacttacagtctaagaagaaaacattgcatataaaaagttacttttttggaaacataaaagtacgttttaaaacttgaacatgacatcattagcactaattctggtttaaatgaaagtcctgcagaaatgccaaagaaggcagggcagagcggcacggattctaggtaattaaaagtgaaagaggcagaagaatagtggacagaactgcaggatagtccttaaaataatggtggtgggaaaggaaaacacagaatgctcctggcaattctaaattcctaggtttgcctttctagaattccttaagaagctgacagagaaatcagagggttacaagaatttcagaaaatttactccaagtgagaggacatactcacaactcctatgaagggtttctaaggtctttgtcctgtgcaatttgacaatgtgccatttctgtgctgtctctgccctctccctatccgtttgttatgggatgggggattaccctgggaatgatttcagctgcttcttacacagatgcctctcaaggtgttcttttgtgtcctctattttcttcttgtgaactgttaaagctacatgcattattttttttccatttactgaaataaagttttcaagttctaaataaaaatattctgactcgatgaaataaataaaggctacaaaagaaggaagaaa

SEQ ID NO: 985 - DNA, 2068 bp, Homo sapiens
gtttgccctcgtagctatttcctggagggaaggggtagctacagtttcctgtccctcttcagcacttctccagctccatatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgaggcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtgagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcagaaaaaaaatgtcttgtggtctttcaaatgctctttagcacaatataaaaattcgtaaccttgctgtagtattttcctacaaaatgttactctgctttcttttaagaatccaaactttaaggatgataacttacagtctaagaag

SEQ ID NO: 986 - DNA, 3279 bp, Homo sapiens
agaccgtgtcccgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgtggcgtctgccaggcccccgagtccgccgagctctgccctcccacttgggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactaccgtggggtttgccagggtgtccgccatgtgctcccacagctcaggggctgtgaaccaggaccacagcaagaaccccgtgggcgtggcctgtaccatggcccatgagatgggccacaacctgggcatggaccatgatgagaacgtccagggctgccgctgccaggaacgcttcgaggccggccgctgcatcatggcgggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcttcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagcattccacggtccagctagtgccgctcagccctagaccctgactttgcaggctcagctgctgttctaacctcaggaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 987 - DNA, 2441 bp, Homo sapiens
agaccgtgtcccgcggggctgtcacctccgcctctgctccccgacccggccatgcgcggcctcgggctctggctgctgggcgcgatgatgctgcctgggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacgtagaggggtacccggactcagccgccagcctcagcacctgtgccggcctcaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactaccgtggggtttgccagggtgtccgccatgtgctcccacagctcaggggctgtgaaccaggaccacagcaagaaccccgtgggcgtggcctgtaccatggcccatgagatgggccacaacctgggcatggaccatgatgagaacgtccagggctgccgctgccaggaacgcttcgaggccggccgctgcatcatggcgggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtgtgcaaccacaagcaggagtgccactgccacgcgggctgggccccgccccactgcgcgaagctgctgactgaggtgcacgcagcgtccgggagcctccccgtcttcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagcattccacggtccagctagtgccgctcagccctagaccctgactttgcaggctcagctgctgttctaacctcaggaatgcatctacctgagaggctcctgctgtccacgccctcagccaattcctt

SEQ ID NO: 988 - DNA, 3077 bp, Homo sapiens
ctgtcacctccgcctctgctccccgacccggccatgcgcggcctcgggctctggctgctgggcgcgatgatgctgcctgcgattgcccccagccggccctgggccctcatggagcagtatgaggtcgtgttgccgtggcgtctgccaggcccccgagtccgccgagctctgccctcccacttgggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactaccgtggggtttgccagggtgtccgccatgtgctcccacagctcaggggctgtgaaccaggaccacagcaagaaccccgtgggcgtggcctgtaccatggcccatgagatgggccacaacctgggcatggaccatgatgagaacgtccagggctgccgctgccaggaacgcttcgaggccggccgctgcatcatggcgggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagcattccacggtccagctagtgccgctcagccctagaccctgactttgcaggctcagctgctgttctaacctcaggaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttc

SEQ ID NO: 989 - DNA, 3839 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctc

SEQ ID NO: 990 - DNA, 4651 bp, Homo sapiens
gcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 991 - DNA, 4230 bp, Homo sapiens
gctcagtgctgaagaccagcccggctcctcctctttgacccctccctgcccaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcacctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacg

SEQ ID NO: 992 - DNA, 4346 bp, Homo sapiens
gacccctccctgcccaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcacctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgtcaggttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgaggtcagccgcccccttccttcgcgcccactgggatgcccaggtggggtgtccacggagacgcctctgcgcggtctccaggttagctgtcccctcctcacttcgcactggggcagcaccctgagcacgaaacgccccttccaactgcagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacg

SEQ ID NO: 993 - DNA, 4622 bp, Homo sapiens
tcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccaggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaagcccaaa

SEQ ID NO: 994 - DNA, 8774 bp, Homo sapiens
gagcgggcgggctgcgaggccgcggggcatgcgggaggcggaggggtggggaccggggtgggctgcgccctcccgctctggcccattccacaccccgccgaaagcggacactgtcagctgaatcactccccttttaggaggagggaggggaaaaaggtgtctagctcctttctgcttaaaaaagcacagggagatcgcgggcagctttgcagtcgctgccttctcgcgcctgaccatgcacccctgcatcttcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccagcacatccttgtgagctctactgccgacccatagatggccagttttctgagaaaatgctggatgctgtcattgatggtaccccttgctttgaaggcggcaacagcagaaatgtctgtattaatggcatatgtaagatggttggctgtgactatgagatcgattccaatgccaccgaggatcgctgcggtgtgtgcctgggagatggctcttcctgccagactgtgagaaagatgtttaagcagaaggaaggatctggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaagcccaaaaggaagccagcttccaccagactgcagcagcctgctgaccatgacatgctttagccctgggagctgcttcgttgaggttttgcttcatatatttcagattcagctttgggtcatgatgaaacaaaatccattgtgttcctctagccaccgaatgtccctcacaggaggcctaggctgccgtacttgctgctccctgataggaaggtgaaatagctaggagaatcaggcagcacctggtatcggctcctgggaaaggtgccaggttagacagatttgtgaaatactgtatttttgttctcccttaaagataaaaacaaagagaccagctatttccctgactacctcaagagtatcaggcaacacttacccaggggacaaataatcttcttaatttatcttgatgaatacctttcttttttttttcttgcctccctgcctggggcagctgctatttaaaatgtcacagcggagctttaggaacattcctttaattcatccaggcagaggactgctttcttcaccccatgttcaactagggcaggaagtgctggttacatccctcagtctcttcctccatccctgtagggctccatatctgggctgcttagagtctcctgccaaccttgggacactagactaagaggaaacaggcataagaaacacagcctaaggggtttaggtcacttacacagaaaacacttctggtttgaagagcatttctatgaaaactcgtaaaatgcaaatgagcagaaatcaatttcttaatattacagaaaaggaactgtgggcctttattcttcccactttcctggcaaatacacactcctttgcagaagggaaaatgtgtcttcctggctgacttcctcccatcctccagtccccacaggaggcctgagctcaggtcccaccatcgtcttgctgcaggggctgtatatgcaaagaccactatgaccagctctagggctgccacctgtcctcacctcttctcaggttggaaaatggaggttccatattaaaatatttcaaagaaccaggtaaattgtactaagtacaagaacatagtgcaaacttctaatctagagaaaaaacatttctaaaaagtaaggtaaaggggatctactcctcagtgtacccaatatgtagttagtcttaaagatcttttactttggggagaacaggtgaatcagggagtccaaagaaactgaaatgaaagttagaatgcttgttctggatgttcctacctcccaccagaagtcaaagtaggcttggtctcaaattcagagcaaatttctagacaaagtgatttctaagggaaggtacttacatgaactgaacccagagaaagagggtaagtgggtgggtggaggggcataagcttcaaatgaaagaagatatcagaaccaattcttgacagggagaaaggcaaggatgtggccttcatgtgatgggcagcatattttctgactcatgcacagatacacttaatactcctcatggaacacaatatcccacgtctccctttacctatccgttcagcagaatggtgctattaaaaaaatggtgctaatatctagatggtggcagaattaatgtaaacatagataggcatacaaatgggtaagtgtatgtgaaactctccatatacatcttctgttaaacatgtaacggtgttgctgaccaatgccagttttattgcttgggtaccttgaatttaagatttaatattatgtgctttttatttttttccaagccattaacgtgtattactctcatgaattcctgtgaaaaataaaacagtgggattgggatgaaattcaagatagaccagaaacaggaggaaagtacaaatgtttacctaaagccagagaatttatttctagatgataattacattattgtattctctgcctttaaacataaacattgctggccgatagcaatctctggtgaataatggttttcgaggagaggagacacttaaattgttagtgacatgagtggaggagaatctgatatttactaatgaggcagtttgcaaagactgtccctgaagtgtagtgtagtctttcagggggattcatttagtaagctagattgatttaacctggtactgtactagcatagggtcaaatacgtgtcatcagagacctgggtatgaccaggcttacaaaactcaggaacaaactcagattcctactgacctcaaccaactaaactaggccaaatttctccgtgtacaaaatggaccacgttatttacaatccacgtggtggagaagatggtagacatgtggagagagtttggccaggtgctccattctaggtctttttccagtttctcaaaggcagaacattggctcctaattatttgccatggatatttgcttcctgttctggagctatgttgtaagacagctgtgtgatgtccatcattcttgactccagaatgaagacagggcttgctgttttctgtcctgttggtatcatctgttgccttggcgatcactcagtgatgagtcgtcagtattttgacatgtcccagtgcttgctgtacaagaggggactcagatcaacaggaagactctgaagacaggaacctgcatggtatcttacatctttgatacttgggtgctgatatgaagcagagttgttgatttactttatctaggcccttctttcttctcacctggatcaagcaactgagaagtgtatcaggagacactggatacatatctctatgaaatagagagggccatcgcagggcctggtacttaactacattaacgttctaaaacccagtttggtttacgttgtctttcacagtagtatatttagctcttctctggaaagttgtgggttaatataattcttaaacatgaaaatgtaattaaacacaccacgagagaacaatattccaggagacttaatagtgattactttcttcaatcaggaaatcgtttcagtgcctcctttgtaggaatgctttgttttgtgatgggttttcttaaagaagagcacacctccgtccaatctcctgagacagccacgtctccgctgacatcccactgtgatgctttcagatagtcagtgaatgtttctgataaccttcatccagtatctgaaacacaatgtgagagattatattgttttagataataacatcccatttagttgactaaaatcttccaaactctgaaagctgcacactgctactccagagagtgcaggtcttagctcttctcctttctgacttcaagatgaatctttgggacgatgtttctggtgcttggtccacagtgattcacttttgaaggagaggccacatgacatgaactgcctggtgttacaacctagctaacatatttgatgctactcctgttgtctgtactgcttattcaagtagtattctaagttatgttactaaaaaacatggtgggtaaagcacaatcctacccatcattgtcctccaaaataattgtatgacatacacggcccagcccattgccctccctgcatctctgtgctgctttgccatttccccttctacccagcctcctcaaggggtaccttggtggatatttcagtacttaaaaccagactgtaatcataacctccctctgtgtggcatcaataaatagccaaactca

SEQ ID NO: 995 - DNA, 1003 bp, Homo sapiens
gcttaaaaaagcacagggagatcgcgggcagctttgcagtcgctgccttctcgcgcctgaccatgcacccctgcatcttcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggttgttttattaaaacatgacctattcttactcaagtctcttatctcctctgtattcttttttttttaatatcttcatgacattcaaatctcttctgtattctcttgccagaaagtgtacattctttttgcttgtataaaccctttcacttgtc

SEQ ID NO: 996 - DNA, 4979 bp, Homo sapiens
agtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggcacctgcgtgcgccatgggacccgcagcggcagcgcctgggagcccgagcgtcccgcgtcctcctccacccgcggagcggccgggctggatggaaaagggcgaatatgacctggtctctgcctacgaggttgaccacaggggcgattacgtgtcccatgaaatcatgcaccatcagcggcggagaagagcagtgcccgtgtccgaggttgagtctcttcaccttcggctgaaaggctccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttgtcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtatctgctttattcaaagatggaacaataggaggaaacatcaacattgcaattgtaggtctgattcttctagaagatgaacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggatttgcacccataagtggaatgtgtagtaaatatcgcagctgcacgattaatgaagatacaggtcttggactggccttcaccattgcccatgagtctggacacaactttggcatgattcatgatggagaagggaacatgtgcaaaaagtccgagggcaacatcatgtcccctacattggcaggacgcaatggagtcttctcctggtcaccctgcagccgccagtatctacacaaatttctaagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggacatctgtaaagccctgtggtgccatcgtattggaaggaaatgtgagactaaatttatgccagcagcagaaggcacaatttgtgggcatgacatgtggtgccggggaggacagtgtgtgaaatatggtgatgaaggccccaagcccacccatggccactggtcggactggtcttcttggtccccatgctccaggacctgcggagggggagtatctcataggagtcgcctctgcaccaaccccaagccatcgcatggagggaagttctgtgagggctccactcgcactctgaagctctgcaacagtcagaaatgtccccgggacagtgttgacttccgtgctgctcagtgtgccgagcacaacagcagacgattcagagggcggcactacaagtggaagccttacactcaagtagaagatcaggacttatgcaaactctactgtatcgcagaaggatttgatttcttcttttctttgtcaaataaagtcaaagatgggactccatgctcggaggatagccgtaatgtttgtatagatgggatatgtgagagagttggatgtgacaatgtccttggatctgatgctgttgaagacgtctgtggggtgtgtaacgggaataactcagcctgcacgattcacaggggtctctacaccaagcaccaccacaccaaccagtattatcacatggtcaccattccttctggagcccggagtatccgcatctatgaaatgaacgtctctacctcctacatttctgtgcgcaatgccctcagaaggtactacctgaatgggcactggaccgtggactggcccggccggtacaaattttcgggcactactttcgactacagacggtcctataatgagcccgagaacttaatcgctactggaccaaccaacgagacactgattgtggagctgctgtttcagggaaggaacccgggtgttgcctgggaatactccatgcctcgcttggggaccgagaagcagccccctgcccagcccagctacacttgggccatcgtgcgctctgagtgctccgtgtcctgcggagggggacagatgaccgtgagagagggctgctacagagacctgaagtttcaagtaaatatgtccttctgcaatcccaagacacgacctgtcacggggctggtgccttgcaaagtatctgcctgtcctcccagctggtccgtggggaactggagtgcctgcagtcggacgtgtggcgggggtgcccagagccgccccgtgcagtgcacacggcgggtgcactatgactcggagccagtcccggccagcctgtgccctcagcctgctccctccagcaggcaggcctgcaactctcagagctgcccacctgcatggagcgccgggccctgggcagagtgctcacacacctgtgggaaggggtggaggaagcgggcagtggcctgtaagagcaccaacccctcggccagagcgcagctgctgcccgacgctgtctgcacctccgagcccaagcccaggatgcatgaagcctgtctgcttcagcgctgccacaagcccaagaagctgcagtggctggtgtccgcctggtcccagtgctctgtgacatgtgaaagaggaacacagaaaagattcttaaaatgtgctgaaaagtatgtttctggaaagtatcgagagctggcctcaaagaagtgctcacatttgccgaagcccagcctggagctggaacgtgcctgcgccccgcttccatgccccaggcaccccccatttgctgctgcgggaccctcgaggggcagctggtttgcctcaccctggtctcagtgcacggccagctgtgggggaggcgttcagacgaggtccgtgcagtgcctggctgggggccggccggcctcaggctgcctcctgcaccagaagccttcggcctccctggcctgcaacactcacttctgccccattgcagagaagaaagatgccttctgcaaagactacttccactggtgctacctggtaccccagcacgggatgtgcagccacaagttctacggcaagcagtgctgcaagacttgctctaagtccaacttgtgagttgggaccgctctccgtagcagagaaagtgcctgcgtggcacagaaatttcccacaaatgagctgtgcaatctacgtcggaatacatccaaggaagagcaaagccaaaagaagaaaaccgtgttaggctctttgaccaggagtgtatgtatgtgtttcactgtgagcctgggtgcagacctgtgtccccatgcacacagtgtctcctgtcaggctgaaatgtggcaccctggcagacagagctgtggctcgtgaggcagaaggcaggcaccacaacgggagaggcagcactcacccctgcctgttgcagctaaatcaagtcaaaaagacaggcgaggctgaacttgctaaatgtctggtgccttagaaaaagaaggaaaggccatgaaataaggaaaacatacaaaatatgtaccccctagttcaccagcctcccctcccactaggagggcccctcgagccatcaggagtgaccaacttcctgggtggaggtcaggggagctccaggaggctgcccaggctcctcctcctcctccccagcggccgagcatctcttaccaggaacctggagccaccgccggagccagcgtcatctctagggtcactggccaggggactgcattctggtttgggactttgcctatggaaatgggaaaaatgaaattcctgctaaggtgcttctatctctttcagattcatgcattgaaggagagattttttatactttatgttttatctttctcagttatttgcaagtgagtgtccttttaaaaacacacttcttcatgcttttctttgtaaatgacagatcgaagtataggttacatcaaaaccctaccatcctgagaagagttatggttctattatagcagacgtcagccacacagcctatgtgacaataaccttagagtcctgtgttttgtttttgtgtgttgtgagattttaatcttttttttttcggtgagtctggccatttctataatgccaggtgggaagccaggctgcgggtgttagggtgggaatctgcccggcgtctctggcaccctccctgccatcctcagtgcggctgctgttctcctgtccggtgctgtggctccattccaaaggggcacctggatatttatatttgctgaagttttataataaagtttatatggtacagtgtg

SEQ ID NO: 997 - DNA, 3286 bp, Homo sapiens
agtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggcacctgcgtgcgccatgggacccgcagcggcagcgcctgggagcccgagcgtcccgcgtcctcctccacccgcggagcggccgggctggatggaaaagggcgaatatgacctggtctctgcctacgaggttgaccacaggggcgattacgtgtcccatgaaatcatgcaccatcagcggcggagaagagcagtgcccgtgtccgaggttgagtctcttcaccttcggctgaaaggctccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttgtcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtatctgctttattcaaagatggaacaataggaggaaacatcaacattgcaattgtaggtctgattcttctagaagatgaacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggatttgcacccataagtggaatgtgtagtaaatatcgcagctgcacgattaatgaagatacaggtcttggactggccttcaccattgcccatgagtctggacacaactttggcatgattcatgatggagaagggaacatgtgcaaaaagtccgagggcaacatcatgtcccctacattggcaggacgcaatggagtcttctcctggtcaccctgcagccgccagtatctacacaaatttctaagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggacatctgtaaagccctgtggtgccatcgtattggaaggaaatgtgagactaaatttatgccagcagcagaaggcacaatttgtgggcatgacatgtggtgccggggaggacagtgtgtgaaatatggtgatgaaggccccaagcccacccatggccactggtcggactggtcttcttggtccccatgctccaggacctgcggagggggagtatctcataggagtcgcctctgcaccaaccccaagccatcgcatggagggaagttctgtgagggctccactcgcactctgaagctctgcaacagtcagaaatgtccccgggacagtgttgacttccgtgctgctcagtgtgccgagcacaacagcagacgattcagagggcggcactacaagtggaagccttacactcaagtagaagatcaggacttatgcaaactctactgtatcgcagaaggatttgatttcttcttttctttgtcaaataaagtcaaagatgggactccatgctcggaggatagccgtaatgtttgtatagatgggatatgtgagagagttggatgtgacaatgtccttggatctgatgctgttgaagacgtctgtggggtgtgtaacgggaataactcagcctgcacgattcacaggggtctctacaccaagcaccaccacaccaaccagtattatcacatggtcaccattccttctggagcccggagtatccgcatctatgaaatgaacgtctctacctcctacatttctgtgcgcaatgccctcagaaggtactacctgaatgggcactggaccgtggactggcccggccggtacaaattttcgggcactactttcgactacagacggtcctataatgagcccgagaacttaatcgctactggaccaaccaacgagacactgattgtggagctgctgtttcagggaaggaacccgggtgttgcctgggaatactccatgcctcgcttggggaccgagaagcagccccctgcccagcccagctacacttgggccatcgtgcgctctgagtgctccgtgtcctgcggagggggacagatgaccgtgagagagggctgctacagagattttttatactttatgttttatctttctcagttatttgcaagtgagtgtccttttaaaaacacacttcttcatgcttttctttgtaaatgacagatcgaagtataggttacatcaaaaccctaccatcctgagaagagttatggttctattatagcagacgtcagccacacagcctatgtgacaataaccttagagtcctgtgttttgtttttgtgtgttgtgagattttaatcttttttttttcggtgagtctggccatttctataatgccaggtgggaagccaggctgcgggtgttagggtgggaatctgcccggcgtctctggcaccctccctgccatcctcagtgcggctgctgttctcctgtccggtgctgtggctccattccaaaggggcacctggatatttatatttgctgaagttttataataaagtttatatggtacagtgtg

SEQ ID NO: 998 - DNA, 6207 bp, Homo sapiens
aattactttttccaaaggctggagggcttcactccggctggcgccgccgcctagcgcgctcctgcttcgccgccacggtccgggggggctgccggtcccgggtaccatgtgtgacggcgccctgctgcctccgctcgtcctgcccgtgctgctgctgctggtttggggactggacccgggcacagctgtcggcgacgcggcggccgacgtggaggtggtgctcccgtggcgggtgcgccccgacgacgtgcacctgccgccgctgcccgcagcccccgggccccgacggcggcgacgcccccgcacgcccccagccgccccgcgcgcccggcccggagagcgcgccctgctgctgcacctgccggccttcgggcgcgacctgtaccttcagctgcgccgcgacctgcgcttcctgtcccgaggcttcgaggtggaggaggcgggcgcggcccggcgccgcggccgccccgccgagctgtgcttctactcgggccgtgtgctcggccaccccggctccctcgtctcgctcagcgcctgcggcgccgccggcggcctggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagaaaagaagaagccgacgtggggcaggccttcgcgggactggcgggagcggaggaacgctatccggctcaccagcgagcacacggtggagaccctggtggtggccgacgccgacatggtgcagtaccacggggccgaggccgcccagaggttcatcctgaccgtcatgaacatggtatacaatatgtttcagcaccagagcctggggattaaaattaacattcaagtgaccaagcttgtcctgctacgacaacgtcccgctaagttgtccattgggcaccatggtgagcggtccctggagagcttctgtcactggcagaacgaggagtatggaggagcgcgatacctcggcaataaccaggttcccggcgggaaggacgacccgcccctggtggatgctgccgtgtttgtgaccaggacagatttctgtgtacacaaggatgaaccgtgtgacactgttggaattgcttacttaggaggtgtgtgcagtgctaagaggaagtgtgtgcttgccgaagacaatggtctcaatttggcctttaccatcgcccatgagctgggccacaacttgggcatgaaccacgacgatgaccactcatcttgcgctggcaggtcccacatcatgtcaggagagtgggtgaaaggccggaacccaagtgacctctcttggtcctcctgcagccgagatgaccttgaaaacttcctcaagtcaaaagtcagcacctgcttgctagtcacggaccccagaagccagcacacagtacgcctcccgcacaagctgccgggcatgcactacagtgccaacgagcagtgccagatcctgtttggcatgaatgccaccttctgcagaaacatggagcatctaatgtgtgctggactgtggtgcctggtagaaggagacacatcctgcaagaccaagctggaccctcccctggatggcaccgagtgtggggcagacaagtggtgccgcgcgggggagtgcgtgagcaagacgcccatcccggagcatgtggacggagactggagcccgtggggcgcctggagcatgtgcagccgaacatgtgggacgggagcccgcttcaggcagaggaaatgtgacaaccccccccctgggcctggaggcacacactgcccgggtgccagtgtagaacatgcggtctgcgagaacctgccctgccccaagggtctgcccagcttccgggaccagcagtgccaggcacacgaccggctgagccccaagaagaaaggcctgctgacagccgtggtggttgacgataagccatgtgaactctactgctcgcccctcgggaaggagtccccactgctggtggccgacagggtcctggacggtacaccctgcgggccctacgagactgatctctgcgtgcacggcaagtgccagaaaatcggctgtgacggcatcatcgggtctgcagccaaagaggacagatgcggggtctgcagcggggacggcaagacctgccacttggtgaagggcgacttcagccacgcccgggggacagctctcaaagactcgggtaaggggtccatcaacagtgactggaagatagagctccccggagagttccagattgcaggcacaactgttcgctatgtgagaagggggctgtgggagaagatctctgccaagggaccaaccaaactaccgctgcacttgatggtgttgttatttcacgaccaagattatggaattcattatgaatacactgttcctgtaaaccgcactgcggaaaatcaaagcgaaccagaaaaaccgcaggactctttgttcatctggacccacagcggctgggaagggtgcagtgtgcagtgcggcggaggggagcgcagaaccatcgtctcgtgtacacggattgtcaacaagaccacaactctggtgaacgacagtgactgccctcaagcaagccgcccagagccccaggtccgaaggtgcaacttgcacccctgccagtcacggtgggtggcaggcccgtggagcccctgctcggcgacctgtgagaaaggcttccagcaccgggaggtgacctgcgtgtaccagctgcagaacggcacacacgtcgctacgcggcccctctactgcccgggcccccggccggcggcagtgcagagctgtgaaggccaggactgcctgtccatctgggaggcgtctgagtggtcacagtgctctgccagctgtggtaaaggggtgtggaaacggaccgtggcgtgcaccaactcacaagggaaatgcgacgcatccacgaggccgagagccgaggaggcctgcgaggactactcaggctgctacgagtggaaaactggggactggtctacgtgctcgtcgacctgcgggaagggcctgcagtcccgggtggtgcagtgcatgcacaaggtcacagggcgccacggcagcgagtgccccgccctctcgaagcctgccccctacagacagtgctaccaggaggtctgcaacgacaggatcaacgccaacaccatcacctccccccgccttgctgctctgacctacaaatgcacacgagaccagtggacggtatattgccgggtcatccgagaaaagaacctctgccaggacatgcggtggtaccagcgctgctgccagacctgcagggacttctatgcaaacaagatgcgccagccaccgccgaactcgtgacacgcagtcccaagggtcgctcaaagctcagactcaggtctgaaacccacccacccgcaagcctaccagccttgtggccacgcccccacccggctgccacaagaatccaactacatagaacatgagcgtggacttggcgtttgccattagtgcttccgtacttaatatattgttaacagccactggctggctttctacagtgaggagaaagtaggcatgagtcacaaagtaacttcaatttctaggatttcaggtacctcgaagggaagcacctctggcagacaaccgtcaagagagagacatcatttagtgttcttgtcttgactcgcttttgacatttgaatttccagtgcttggtatatcatggaggaaacatccccaaaacgagacatgctagaaaaggctttattctgaaagccggcgacaccatggagggaggggcaggtgttggtgagcctctgcccgtggcttctctggggagggccgggctgcttagcacacgtttctctccatctaccttcttgaccacatgagaaccaggacgttgcctccatgcccgtctctgagaacatagtctctaaatcctaggtgttgccttggaagtctcgtgcgtggagtgtaaatctatatatgccagcgaggacagcagtgccacgcagttcataccacccgcatgggaagaatgttccaagagagtctgggtttggggaagcatctaattttcagagctctgctgtccaccgtgtagggaaacagaagggcctctcttcaaggtgctgtgacataagaaacggtaattgcggtgatggggttgcttcctaaggcaaaggtaagcttgggccagcttcactggggcggatgggcacctgccccgccttccgggaacatccactctggcctgcacttcctaaagctttgtaccttagagatgctgtaccacatcccagtggctttctaccgaccgtggccatttatctgaaggtaagacgacatttgggacctctgaggacacaagcccaggcctaggatctgtagagcaaggcctgactgctctatcctggcacggagcagcctgatgtgccaggaccaggggaggaacgccatctggctggcactgctgcacacccgccgagccttcctgtagccccagactttgtggtacccattatcatcacgcctgtcatcattgacccatcttcttggtggggcaaggatgatgcatgatgaaggaaggtccttcccccctgcagcccccttacgcctggcagcagacaagcagagtggcctctttgagagcacagaggatggtagcaccctacctgcaaggaggccgggcagggaccctagatgccaggaggcctgttttgctcaccaacttggtgggcatttcatgggtgcttatgttctaggactttaccgtaaataacacctcctccctgatttcagacggaaggtctcacttggacttccatgggatcatctccctgtgcttcttgatttattggtgctgtgtttctgtgttttgttttgttacatgtcacaaccgtagagttagcttaaatcagaaagaagcctctctgccttctccaccctgtcttacgagctgtgtttttgtttttactaccctagaggcagagaagcggtagggatgtcagggaatttactcacttccacttgaatcaacgagaagtgttgagaaacttccgtgggtgctctgtggaaagaaccgagggtgtcaggatggagcggcccaccctcgccccgcggcctgcgcagactgctgtcctccccttcaggcctggccaccagcagactcccatgaattcccattttcacaaagccctcaaaattttgggggcgctgaggttcaattttcttcatccccaaatgaactgttaattcactgaaagacatttagacttttgcagccaaggagcagagccgggcaagctcactaaggaagccttagcttggtctcctgcatgggccccggggcctccagatatgcccactgtcaccctggcaagggccccacaccctcagaatgaaaaggattgattgggttattgtcagatacccccattagttcccctaaagtctgcatctgcagagctcttttagctcatctttttgttgtcggtgttgttttttgagacagagtctccctctgttgcccaggctggagtgcagtggcgcgatctcagctcattgaaagctccgcctcccgggttcaggccattcttctgcctcaccctccccagtagctgggactacaggcgcccaccaccacgcccacctacttttttgtatttttactagagacggggtttcaccatgttagccaggatggtctcgatctcctgacctcatgatccacccgcctcagccttccaaagtgctgggattacaggagtgagccaccgcgcccggccttttagcttatcttgaaatccaccagcctaccttctgttcatggcacgagcagtgatttcagtgaaaccatcataaacattcttgttccactagatgctgatcacagcagtgatgtttctgtgttaataccctgtactgtccctcgagtactgtacctttgtgcttgcacacgtgtcactaacgcacgtgttaccagagtctcacgaccctacggtgctatttttattggtgcaaaattaaaccctctcagctgaccgttgctggataggatcagaatgcaggaaaagagcctctatggcaatacgattgtccttttttcgtttcagagtcaaatgtatctattttccattcgttaacttgcattacatactgtacccatg

SEQ ID NO: 999 - DNA, 5913 bp, Homo sapiens
aatcaccgcgcggtggagaggcgggcgctcggctccggcgcgctgggggagccagctggcgctgtcttccccatcgcctcagacgctcacaccgacacagacagacgcacagacgggcgggcagacaccgacagtctcccaaccgtttgcgctccagtcccggcccagggagccccccgtaccctctggggtgccgcaaactgcagctcggcaggcccgcgccgggagaagggagggcgcgcaggcggccggaggaggggaggtcccagcgcgcccccgctgcgatgtgaacggcggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcgctccagctgtgctgcctctgctgtgcgtcggtcgccgcggccttagccagtgacagcagcagcggcgccagcggattaaatgatgattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatatgctcccaagcctcccacagaggacacctatctaaggtttgatgaatatgggagctctgggcgacccagaagatcagctggaaaatcacaaaagggcctcaatgtggaaaccctcgtggtggcagacaagaaaatggtggaaaagcatggcaagggaaatgtcaccacatacattctcacagtaatgaacatggtttctggcctatttaaagatgggactattggaagtgacataaacgtggttgtggtgagcctaattcttctggaacaagaacctggaggattattgatcaaccatcatgcagaccagtctctgaatagtttttgtcaatggcagtctgccctcattggaaagaatggcaagagacatgatcatgccatcttactaacaggatttgatatttgttcttggaagaatgaaccatgtgacactctagggtttgcccccatcagtggaatgtgctctaagtaccgaagttgtaccatcaatgaggacacaggacttggccttgccttcaccatcgctcatgagtcagggcacaactttggtatgattcacgatggagaagggaatccctgcagaaaggctgaaggcaatatcatgtctcccacactgaccggaaacaatggagtgttttcatggtcttcctgcagccgccagtatctcaagaaattcctcagcacacctcaggcggggtgtctagtggatgagcccaagcaagcaggacagtataaatatccggacaaactaccaggacagatttatgatgctgacacacagtgtaaatggcaatttggagcaaaagccaagttatgcagccttggttttgtgaaggatatttgcaaatcactttggtgccaccgagtaggccacaggtgtgagaccaagtttatgcccgcagcagaagggaccgtttgtggcttgagtatgtggtgtcggcaaggccagtgcgtaaagtttggggagctcgggccccggcccatccacggccagtggtccgcctggtcgaagtggtcagaatgttcccggacatgtggtggaggagtcaagttccaggagagacactgcaataaccccaagcctcagtatggtggcttattctgtccaggttctagccgtatttatcagctgtgcaatattaacccttgcaatgaaaatagcttggattttcgggctcaacagtgtgcagaatataacagcaaacctttccgtggatggttctaccagtggaaaccctatacaaaagtggaagaggaagatcgatgcaaactgtactgcaaggctgagaactttgaatttttttttgcaatgtccggcaaagtgaaagatggaactccctgctccccaaacaaaaatgatgtttgtattgacggggtttgtgaactagtgggatgtgatcatgaactaggctctaaagcagtttcagatgcttgtggcgtttgcaaaggtgataattcaacttgcaagttttataaaggcctgtacctcaaccagcataaagcaaatgaatattatccggtggtcctcattccagctggcgcccgaagcatcgaaatccaggagctgcaggtttcctccagttacctcgcagttcgaagcctcagtcaaaagtattacctcaccgggggctggagcatcgactggcctggggagttccccttcgctgggaccacgtttgaataccagcgctctttcaaccgcccggaacgtctgtacgcgccagggcccacaaatgagacgctggtctttgaaattctgatgcaaggcaaaaatccagggatagcttggaagtatgcacttcccaaggtcatgaatggaactccaccagccacaaaaagacctgcctatacctggagtatcgtgcagtcagagtgctccgtctcctgtggtggaggttacataaatgtaaaggccatttgcttgcgagatcaaaatactcaagtcaattcctcattctgcagtgcaaaaaccaagccagtaactgagcccaaaatctgcaacgctttctcctgcccggcttactggatgccaggtgaatggagtacatgcagcaaggcctgtgctggaggccagcagagccgaaagatccagtgtgtgcaaaagaagcccttccaaaaggaggaagcagtgttgcattctctctgtccagtgagcacacccactcaggtccaagcctgcaacagccatgcctgccctccacaatggagccttggaccctggtctcagtgttccaagacctgtggacgaggggtgaggaagcgtgaactcctctgcaagggctctgccgcagaaaccctccccgagagccagtgtaccagtctccccagacctgagctgcaggagggctgtgtgcttggacgatgccccaagaacagccggctacagtgggtcgcttcttcgtggagcgagtgttctgcaacctgtggtttgggtgtgaggaagagggagatgaagtgcagcgagaagggcttccagggaaagctgataactttcccagagcgaagatgccgtaatattaagaaaccaaatctggacttggaagagacctgcaaccgacgggcttgcccagcccatccagtgtacaacatggtagctggatggtattcattgccgtggcagcagtgcacagtcacctgtgggggaggggtccagacccggtcagtccactgtgttcagcaaggccggccttcctcaagttgtctgctccatcagaaacctccggtgctacgagcctgtaatacaaacttctgtccagctcctgaaaagagagaggatccatcctgcgtagatttcttcaactggtgtcacctagttcctcagcatggtgtctgcaaccacaagttttacggaaaacaatgctgcaagtcatgcacaaggaagatctgatcttggtgtcctccccagcaccttagggccaggggcttacctttcaacctctagagagaccagctgcctttgagaccaggagctgagcaccgagaaccatctgtgagctgccgctgtgatgaaggagcctgctctgaggaacagacaggttgccagtaggcttctagctcaattccctgaagcacgtggtactctgaagcacttgaaaatgggaagcgatgacaaatctgactttaaaaaaaatctttgatttgcactgttatatgcaagaagtggtgaatcacactgagatacgtcgatttggggagagacccccttttgaacttcaaagggttcaagggcaaagacatctgttttaaaaaggtcctttatgacttcaggtcaaagactgagactcagaactttcaaatctggatggaataccttgcctaactgttgcgtggagttcacagttcgactaaccctgtgaacacccaagccaggagttctatgagaagccaaatggtgctcgcaattgtgcttgctgctggactggcaagcttcatgttatgtttatttggtgtgcgtgtgtctttattattttgtgtaaactatattctgcttatagagagtctctgagactaaaattgacaacttgaaaagtattccaaggaatattatgaaaatagggcaacatggactgtttaagatctccatgtaattgaaattcatgcaaggaaacaactcatagaaaagataaatatggatgcccttcacatgttatcaacctcgtaacttttggtgcttgctgaatcagtccatgaaaagctacagcccgctctttgggaatgctacatacccatttctggtatttaaaaaatatctaggaggagctaaatgacaaaacacagcagtgttttgagggagaaaggaccatcatttataatgctctgtacatactaccagagctgcttggaaaattaaaggccacttgtggctttttcctaccaactgatacgtttaaatttgccctaggattgagctaacagcaaaaaaaaaaaaaaaaaaaagagagaaagaaaggagtaaacagtggtaataaaaaaatccatctgtcttcttgctatgttaatattaataaatcataatatgacaagaccctcactgaataagagtattttcagtcatcagaagccagctgttggtaggcattaatgagtttaaaattgttctcaattgaaaaaacatcacactattttgccaaaaccaaagtaattataatactgtgtcctcctgtaattttttgagaagtggttataaagggcatatttacataaattctactttattcctcaacttctttgatgaatgtaacccaattttacttctttaaaaagtctcaattcaagctggattagccagctcagcataatcaactagacagtggtttgttaaatttagcagcatacttcgttcccattctaattaaagtcatgagttcttgaatcccagagaaataatgcttaggaacttctctcaatctgcttggcttggcctagagaagtggccattttatcaacaggaaaaaaaaaaattttctctactacaaccccgttgccttctgaaaaacagcaagttatttctttatataattatcattttattattttatggaaaattaatttattaattaatagcctattatgtgttctcacttgcttctctaagtaatattttgagataaaatgttgaataaaaccatggattatagagaaaagtcaaaatatatgtgtaatatttaattattttataagttttataataaagtattccatttctttatctttga

SEQ ID NO: 1000 - DNA, 1632 bp, Homo sapiens
agacgctcacaccgacacagacagacgcacagacgggcgggcagacaccgacagtctcccaaccgtttgcgctccagtcccggcccagggagccccccgtaccctctggggtgccgcaaactgcagctcggcaggcccgcgccgggagaagggagggcgcgcaggcggccggaggaggggaggtcccagcgcgcccccgctgcgatgtgaacggcggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcgctccagctgtgctgcctctgctgtgcgtcggtcgccgcggccttagccagtgacagcagcagcggcgccagcggattaaatgatgattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatgtatatgctcccaagcctcccacagaggacacctatctaaggtttgatgaatatgggagctctgggcgacccagaagatcagctggaaaatcacaaaagggcctcaatgtggaaaccctcgtggtggcagacaagaaaatggtggaaaagcatggcaagggaaatgtcaccacatacattctcacagtaatgaacatggtttctggcctatttaaagatgggactattggaagtgacataaacgtggttgtggtgagcctaattcttctggaacaagaacctggtttgcccccatcagtggaatgtgctctaagtaccgaagttgtaccatcaatgaggacacaggacttggccttgccttcaccatcgctcatgagtcagggcacaactttggtatgattcacgatggagaagggaatccctgcagaaaggctgaaggcaatatcatgtctcccacactgaccggaaacaatggagtgttttcatggtcttcctgcagccgccagtatctcaag

SEQ ID NO: 1001 - DNA, 6754 bp, Homo sapiens
agctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcatccctagcatttttttcttgcttatagagatattccatgggatagcaaatcctgtgtcatggagatgaagtcaaaattcctgattccaaaaggttttgagaaaacaaagagggggaatgacgtaagaaagataggcatgagcatgtggtaactaggttagcacgtgtgcttcccagcccaggagcgaccaaatactgtggtggcgtcaggtgtgcagtggagaggaatatagaggctgtatggcctccctcagtgagggcagggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagcggttcaagggcctggaatctccctacggccaagtctaagggttctgggattctgggctttgtgggctttgcttgcttgctgggaatgggctttccctgtcccgccctgccccacctcgcctctgtctctcagaagctccagaacccagcagtgacctgcaaaatgtggcctctgatgggggcttagggtgggagatggggagagcctacattgtcttttgctccttgaaaactttaatagctcctattttccagagaatggtgctttgtgagcaacatgcgagtaagagagaaataggaggaagggggagtaggggcggatgggagaagagtggctcatttttacctctcactgccttgacattttgtgaacgtgaagcttaaactttctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtgcaatcctgcctctgtaattaggaaacggagcccgaggctttccattgttggttgaacccaggacagctggtgctattcacaggctgaagaactgggcagttcttacttgggtctgtcctaggatgtggaggaagttcaggactaacgctaggcagagagtatgactcggtttacccagcctaggggcctctggatgggaacactccattccaagatctcagcagagcagggcttcctggcttgaggctggaagcctttgggaagaggcccagctgggacattccctgggcacctgtcttccgctgaagggagcaaggtgccctctgggactgacagccatgaccctctgtgccatcctcaatccttgagccatatatcaagagtcctctagagccggatggtcctcaaaagtctgtccaaggaatgccaacgttcaccgggctctgagaaacgacgcaaatctctgagctggggaccacttggagaaccggcttagtaacagtcctgatcttcgcaagccagcttcttctgcatctgaggggctcctggcgcccagaggaggcagacagatgtcttctagctgagtttctaaccgcatgatgagactcagaccttccgctgcactagaaaatctgcaacagtgtccctgagtcacttctccttagtgggcagactcgtgttagatttgtggaacccagctctctgatttactccttttggaaaacccatggaatttcatgtataaggctttcatttgtattttaaggtttttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgatacaacaaccaatacatctttgttctgtaatgtaaaatttgactccttacttttataacttattaaagttaaaatgtctgtgtttttgcaaatcatg

SEQ ID NO: 1002 - DNA, 2044 bp, Homo sapiens
agctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgca

SEQ ID NO: 1003 - DNA, 4515 bp, Homo sapiens
atgtgggtggccaagtggctgactgggctgctctaccatctctcgctcttcatcaccaggtcttgggaagttgacttccaccccaggcaagaagccctggtgaggacactgacctcctacgaagtagtgatccccgagcgggtcaatgagtttggagaagtgttccctcagagccaccacttcagccggcagaaacgcagctccgaggcgctggaacccatgccgttccgaacccactatcgcttcactgcctacgggcagctcttccagctgaacctgaccgccgatgcatcctttctggccgccggctacaccgaggtgcacttgggaaccccggagcgcggggcctgggagagcgacgcagggccctcggacctgcgccactgcttctaccgcggccaggtcaactcacaggaggattacaaggccgtcgtcagcttatgcggaggcctgacgggaacatttaaaggacagaacggtgaatatttcttagaacctataatgaaggcagatgggaatgaatatgaagatggtcacaacaagccacatcttatatacagacaagacttaaataactcttttctgcagactctgaagtattgcagtgtgtcagaaagtcaaataaaggaaaccagtttaccctttcatacctacagcaacatgaatgaagatcttaatgtaatgaaagaaagagttttaggacacacatcaaaaaatgtaccattgaaagatgaaagaagacattccaggaaaaaacgtcttatatcatatccaagatacattgaaattatggttacagctgatgctaaagtggtttctgctcatggatcgaatttgcaaaactatatactgactctaatgtcaattgttgcaacaatctacaaagatccaagtattggaaatttgatacacatagtagtggtaaaattagttatgattcaccgtgaggaggaaggaccagtcattaattttgatggtgctaccacattaaagaacttttgttcatggcaacaaactcagaatgaccttgatgatgttcacccttcccaccatgacactgctgttcttatcactagggaagacatttgttcatctaaagagaaatgtaacatgttaggtttatcatatttaggtaccatatgtgatcctttacaaagctgctttattaatgaagaaaaaggactcatttctgcttttactatagcccatgagcttgggcacacacttggtgttcaacatgatgataatcctagatgtaaagaaatgaaagttacaaagtatcatgtaatggcccctgctttaagttttcacatgagtccttggagctggtcaaactgtagtcggaaatatgttactgaattcctagatactggttacggggaatgtcttcttgacaaaccagatgaagaaatatataatctgccttcagaacttcctggatcacgatatgatggaaacaagcagtgtgagcttgcgtttggtcctgggtcacaaatgtgtccccatataaatatatgcatgcatctgtggtgcacaagcacagaaaagcttcacaaaggctgtttcactcaacacgtgccaccagcagatggaacagactgcggtcctggaatgcattgccgtcatgggctatgtgtaaacaaagaaacggaaacacgtcctgtaaatggtgaatggggaccatgggaaccttacagttcttgttcaagaacatgtggaggcggaatcgaaagtgcaaccaggcgctgtaatcgtcctgagccaagaaacggaggaaattactgtgtgggccgcaggatgaaatttcgatcatgtaatactgattcatgtccaaaaggcacacaagactttcgagagaagcagtgctctgattttaatggtaaacatttggacatcagtggcattccctctaatgtgaggtggcttccaagatacagtggcattggcacaaaggatcgttgtaaactctattgtcaggttgctggaaccaattatttctacctattgaaggatatggttgaagatggtactccttgtggaactgaatcttataatattgattgtaattgtgtcttgaaggcagctggttgtgatcacgtgttaaactccagtgccaagatagacaaatgtggagtgtgtggtggggacaactcttcatgcaagacaataacaggtgtcttcaacagttctcattatggttataatgttgttgtaaagattcccgcaggagcaacaaacgttgacattcgtcagtacagctattctggacaaccagatgacagttaccttgcattatctgacgctgaagggaattttcttttcaatggaaattttcttctaagtacgtcaaaaaaagaaatcaatgtgcaaggaacaagaactgttattgaatacagtggatcaaataacgcagttgaaagaattaatagtactaatcgacaagagaaagaaattcttattgaggtgttgtgtgtgggtaatttatacaaccctgatgtacattattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcatgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagagctgtgtacttacaccttgctcatttatttctaaacttgagaccgctttattaccaactgttctcataaaaaagatggcacaatggcgacatggttcttggaccccatgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccatcagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggatcatgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcggaggatcttaaagtgaaattgctgcctcaaaggaccatcatcttgtgggaactaatgaaaaacatattttgccatggaaagcactcacatatgtatttaataaatgtcgttactgaccatctactatatcctaggcactgtgatccagagacaattgaaacatatttcttatccctatggagtttacagtttacttggggagatttgaaatactataagaactcactataa

SEQ ID NO: 1004 - DNA, 6076 bp, Homo sapiens
atgtgggtggccaagtggctgactgggctgctctaccatctctcgctcttcatcaccaggtcttgggaagttgacttccaccccaggcaagaagccctggtgaggacactgacctcctacgaagtagtgatccccgagcgggtcaatgagtttggagaagtgttccctcagagccaccacttcagccggcagaaacgcagctccgaggcgctggaacccatgccgttccgaacccactatcgcttcactgcctacgggcagctcttccagctgaacctgaccgccgatgcatcctttctggccgccggctacaccgaggtgcacttgggaaccccggagcgcggggcctgggagagcgacgcagggccctcggacctgcgccactgcttctaccgcggccaggtcaactcacaggaggattacaaggccgtcgtcagcttatgcggaggcctgacgggaacatttaaaggacagaacggtgaatatttcttagaacctataatgaaggcagatgggaatgaatatgaagatggtcacaacaagccacatcttatatacagacaagacttaaataactcttttctgcagactctgaagtattgcagtgtgtcagaaagtcaaataaaggaaaccagtttaccctttcatacctacagcaacatgaatgaagatcttaatgtaatgaaagaaagagttttaggacacacatcaaaaaatgtaccattgaaagatgaaagaagacattccaggaaaaaacgtcttatatcatatccaagatacattgaaattatggttacagctgatgctaaagtggtttctgctcatggatcgaatttgcaaaactatatactgactctaatgtcaattgttgcaacaatctacaaagatccaagtattggaaatttgatacacatagtagtggtaaaattagttatgattcaccgtgaggaggaaggaccagtcattaattttgatggtgctaccacattaaagaacttttgttcatggcaacaaactcagaatgaccttgatgatgttcacccttcccaccatgacactgctgttcttatcactagggaagacatttgttcatctaaagagaaatgtaacatgttaggtttatcatatttaggtaccatatgtgatcctttacaaagctgctttattaatgaagaaaaaggactcatttctgcttttactatagcccatgagcttgggcacacacttggtgttcaacatgatgataatcctagatgtaaagaaatgaaagttacaaagtatcatgtaatggcccctgctttaagttttcacatgagtccttggagctggtcaaactgtagtcggaaatatgttactgaattcctagatactggttacggggaatgtcttcttgacaaaccagatgaagaaatatataatctgccttcagaacttcctggatcacgatatgatggaaacaagcagtgtgagcttgcgtttggtcctgggtcacaaatgtgtccccatataaatatatgcatgcatctgtggtgcacaagcacagaaaagcttcacaaaggctgtttcactcaacacgtgccaccagcagatggaacagactgcggtcctggaatgcattgccgtcatgggctatgtgtaaacaaagaaacggaaacacgtcctgtaaatggtgaatggggaccatgggaaccttacagttcttgttcaagaacatgtggaggcggaatcgaaagtgcaaccaggcgctgtaatcgtcctgagccaagaaacggaggaaattactgtgtgggccgcaggatgaaatttcgatcatgtaatactgattcatgtccaaaaggcacacaagactttcgagagaagcagtgctctgattttaatggtaaacatttggacatcagtggcattccctctaatgtgaggtggcttccaagatacagtggcattggcacaaaggatcgttgtaaactctattgtcaggttgctggaaccaattatttctacctattgaaggatatggttgaagatggtactccttgtggaactgaaactcatgacatctgtgttcaaggccagtgtatggcagctggttgtgatcacgtgttaaactccagtgccaagatagacaaatgtggagtgtgtggtggggacaactcttcatgcaagacaataacaggtgtcttcaacagttctcattatggttataatgttgttgtaaagattcccgcaggagcaacaaacgttgacattcgtcagtacagctattctggacaaccagatgacagttaccttgcattatctgacgctgaagggaattttcttttcaatggaaattttcttctaagtacgtcaaaaaaagaaatcaatgtgcaaggaacaagaactgttattgaatacagtggatcaaataacgcagttgaaagaattaatagtactaatcgacaagagaaagaacttattttgcaggtgttgtgtgtgggtaatttatacaaccctgatgtacattattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcatgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagagctgtgtacttacaccttgctcatttatttctaaacttgagaccgctttattaccaactgttctcataaaaaagatggcacaatggcgacatggttcttggaccccatgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccatcagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggatcatgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcgtgctcagcttcttgtggtaaaggtagaaagtaccgtgaagtgttttgcattgaccaattccaaaggaaattagaagacacaaattgcagtcaagtacagaaacctccaactcacaaagcctgtagatctgtcagatgcccttcatggaaagccaatagctggaatgagtgctctgtgacctgtggctctggagttcagcagagggatgtatactgcagactgaaaggtgttggtcaggtggttgaagaaatgtgtgatcagtccacccgaccttgttctcagaggcgatgttggagtcaggactgtgtgcagcacaaggggatggaaagagggaggctgaattgttcaacatcatgtgagagaaaagattcacatcaacgaatggagtgcacagataaccaaatcagacaagtgaatgaaatagtctataattcttcaaccatatctcttacatccaagaattgcaggaaccctccttgcaattacattgtggtaacagcagactcatcacagtgtgcaaacaactgtggatttagttacagacaaaggattacatattgcaccgagatcccatctactaagaaacataagctccatcgacttcggcctatagtttatcaagaatgccctgtggtgccttcctctcaggtttaccaatgcattaacagctgtttgcatttggccacttggaaagttggaaaatggagcaagtgctcagtgacttgtggaattgggataatgaagagacaagtgaaatgcattaccaaacatggtttgtccagtgacttatgtttaaaccatttaaaaccaggtgctcaaaagaaatgttatgccaatgactgtaaatcatttaccacctgcaaagaaattcaagtgaaaaaccacattagaaaggatggtgactattaccttaacattaagggaagaataataaagatttattgtgcagacatgtacttggagaaccctaaggaatatttaacactggtccaaggtgaagaaaacttttctgaagtgtatggctttagactaaaaaatccatatcaatgtccttttaatgggagtagaagggaagactgtgaatgtgacaatggacacttagctgctggatacactgttttcagcaaaataagaattgatctcacttccatgcaaattaaaactacggaccttcttttttccaaaacaatatttggaaatgcagttccatttgccacagctggagattgctacagtgctttcagatgcccacagggacagtttagcattaatttgtcaggaactgggatgaagatatccagcacagcaaagtggctcactcaggggagttatacctctgtcagcatacgaagatcagaggatggaactagatttttcggcaaatgtggagggtactgtggaaagtgtcttcctcacatgactactggtctcccaattcaagtcatatgaacatttagaagggggaagtatgccctaaagaggggatattctctggaatattcaaataactggtgctcatttctttatatctcccttcccgagatttccatgtccaatatgtctctgcctttttttcagggtgctcatcagggattcaaatcactgcttaataaggtctataaaagaaatttaagagctatcttaatttattttatatctaatcaggatattttttaaagaacataataatttataatagagaataccaggattgaatgaattataccaagacagtgttgctcttaacatcttggcctggaccacacttattttatacctataaacacacatg

SEQ ID NO: 1005 - DNA, 2780 bp, Homo sapiens
tattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcatgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagtgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccatcagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggatcatgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcggaggatcttaaagtgaaattgctgcctcaaaggaccatcatcttgtgggaactaatgaaaaacatattttgccatggaaagcactcacatatgtatttaataaatgtcgttactgaccatctactatatcctaggcactgtgatccagagacaattgaaacatatttcttatccctatggagtttacagtttacttggggagatttgaaatactataagaactcactataaaaagatatttttattagctatcttagattggaaatccactttctgcttactgtgtctctgttccatcttctttcattttattggttttagtttgcaagcctagttcttaagaagactgtggattactttcttggaattttttcccaattaggagagcagaatcctaactgctaatgagattgaattgtaatggcatttgtttctgagcatagacgttttattttccctacccattcatgacttcaattcaccaagcattaaacatttacttaggtctcatgctttatattagatattgaagcaattaaaattaagtgtttgtgagtcagattctctgttttagaggtcagcaaactatggtccaggtaccaaatctggcctgttgcctatttttaaaataagttctattggaacacagtcatgctcatttgtttacgtgttatctatggctggttttgcactacagcagtagcattgattagttgcaatagaaactctgtaactcacaaagcctgaaatatttactatctaactttttctgggaaaagtttgctgacccctgttctatttaataaacattataatgcttttaagtttaacataaaaaggtacttagatttatagaatattaaaattacaaataattcattccaggtcagttttagatgtttttgatcctttgatattttacattttaaggtttatcaaccttctctacatatccactgtgatattcatgcaatgtttatgtaaatgtatctatactatattccaatatatttttgttatgctattttttgtatgtaaattatatcacaagtgaaaaatctgaatgctcattaaagtcctctgtatagatgacttttcaacctcac

SEQ ID NO: 1006 - DNA, 4633 bp, Homo sapiens
atgtgggtggccaagtggctgactgggctgctctaccatctctcgctcttcatcaccaggtcttgggaagttgacttccaccccaggcaagaagccctggtgaggacactgacctcctacgaagtagtgatccccgagcgggtcaatgagtttggagaagtgttccctcagagccaccacttcagccggcagaaacgcagctccgaggcgctggaacccatgccgttccgaacccactatcgcttcactgcctacgggcagctcttccagctgaacctgaccgccgatgcatcctttctggccgccggctacaccgaggtgcacttgggaaccccggagcgcggggcctgggagagcgacgcagggccctcggacctgcgccactgcttctaccgcggccaggtcaactcacaggaggattacaaggccgtcgtcagcttatgcggaggcctgacgggaacatttaaaggacagaacggtgaatatttcttagaacctataatgaaggcagatgggaatgaatatgaagatggtcacaacaagccacatcttatatacagacaagacttaaataactcttttctgcagactctgaagtattgcagtgtgtcagaaagtcaaataaaggaaaccagtttaccctttcatacctacagcaacatgaatgaagatcttaatgtaatgaaagaaagagttttaggacacacatcaaaaaatgtaccattgaaagatgaaagaagacattccaggaaaaaacgtcttatatcatatccaagatacattgaaattatggttacagctgatgctaaagtggtttctgctcatggatcgaatttgcaaaactatatactgactctaatgtcaattgttgcaacaatctacaaagatccaagtattggaaatttgatacacatagtagtggtaaaattagttatgattcaccgtgaggaggaaggaccagtcattaattttgatggtgctaccacattaaagaacttttgttcatggcaacaaactcagaatgaccttgatgatgttcacccttcccaccatgacactgctgttcttatcactagggaagacatttgttcatctaaagagaaatgtaacatgttaggtttatcatatttaggtaccatatgtgatcctttacaaagctgctttattaatgaagaaaaaggactcatttctgcttttactatagcccatgagcttgggcacacacttggtgttcaacatgatgataatcctagatgtaaagaaatgaaagttacaaagtatcatgtaatggcccctgctttaagttttcacatgagtccttggagctggtcaaactgtagtcggaaatatgttactgaattcctagatactggttacggggaatgtcttcttgacaaaccagatgaagaaatatataatctgccttcagaacttcctggatcacgatatgatggaaacaagcagtgtgagcttgcgtttggtcctgggtcacaaatgtgtccccatataaatatatgcatgcatctgtggtgcacaagcacagaaaagcttcacaaaggctgtttcactcaacacgtgccaccagcagatggaacagactgcggtcctggaatgcattgccgtcatgggctatgtgtaaacaaagaaacggaaacacgtcctgtaaatggtgaatggggaccatgggaaccttacagttcttgttcaagaacatgtggaggcggaatcgaaagtgcaaccaggcgctgtaatcgtcctgagccaagaaacggaggaaattactgtgtgggccgcaggatgaaatttcgatcatgtaatactgattcatgtccaaaaggcacacaagactttcgagagaagcagtgctctgattttaatggtaaacatttggacatcagtggcattccctctaatgtgaggtggcttccaagatacagtggcattggcacaaaggatcgttgtaaactctattgtcaggttgctggaaccaattatttctacctattgaaggatatggttgaagatggtactccttgtggaactgaaactcatgacatctgtgttcaaggccagtgtatggcagctggttgtgatcacgtgttaaactccagtgccaagatagacaaatgtggagtgtgtggtggggacaactcttcatgcaagacaataacaggtgtcttcaacagttctcattatggttataatgttgttgtaaagattcccgcaggagcaacaaacgttgacattcgtcagtacagctattctggacaaccagatgacagttaccttgcattatctgacgctgaagggaattttcttttcaatggaaattttcttctaagtacgtcaaaaaaagaaatcaatgtgcaaggaacaagaactgttattgaatacagtggatcaaataacgcagttgaaagaattaatagtactaatcgacaagagaaagaacttattttgcaggtgttgtgtgtgggtaatttatacaaccctgatgtacattattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcatgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagagctgtgtacttacaccttgctcatttatttctaaacttgagaccgctttattaccaactgttctcataaaaaagatggcacaatggcgacatggttcttggaccccatgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccatcagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggatcatgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcggaggatcttaaagtgaaattgctgcctcaaaggaccatcatcttgtgggaactaatgaaaaacatattttgccatggaaagcactcacatatgtatttaataaatgtcgttactgaccatctactatatcctaggcactgtgatccagagacaattgaaacatatttcttatccctatggagtttacagtttacttggggagatttgaaatactataagaactcactataaaaagatatttttattagctatcttagattggaaatccactttctgcttactgtgtctctgttccatcttctttcattttattggttttagtttgcaagcctagttcttaagaagactg

SEQ ID NO: 1007 - DNA, 5822 bp, Homo sapiens
gctttgcccagtagttggaaagtgaactcgactcgtgatggttctcctgtcactttggttgatagcagccgctctggtagaggttaggacttcagctgatggacaagctggtaatgaagaaatggtgcaaatagatttaccaataaagagatatagagagtatgagctggtgactccagtcagcacaaatctagaaggacgctatctctcccatactctttctgcgagtcacaaaaagaggtcagcgagggacgtgtcttccaaccctgagcagttgttctttaacatcacggcatttggaaaagattttcatctgcgactaaagcccaacactcaactagtagctcctggggctgttgtggagtggcatgagacatctctggtgcctgggaatataaccgatcccattaacaaccatcaaccaggaagtgctacgtatagaatccggagaacagagcctttgcagactaactgtgcttatgttggtgacatcgtggacattccaggaacctctgttgccatcagcaactgtgatggtctggctggaatgataaaaagtgataatgaagagtatttcattgaacccttggaaagaggtaaacagatggaggaagaaaaaggaaggattcatgttgtctacaagagatcagctgtagaacaggctcccatagacatgtccaaagacttccactacagagagtcggacctggaaggccttgatgatctaggtactgtttatggcaacatccaccagcagctgaatgaaacaatgagacgccgcagacacgcgggagaaaacgattacaatatcgaggtactgctgggagtggatgactctgtggtccgtttccatggcaaagagcacgtccaaaactacctcctgaccctaatgaacattgtgaatgaaatttaccatgatgagtccctcggagtgcatataaatgtggtcctggtgcgcatgataatgctgggatatgcaaagtccatcagcctcatagaaaggggaaacccatccagaagcttggagaatgtgtgtcgctgggcgtcccaacagcaaagatctgatctcaaccactctgaacaccatgaccatgcaatttttttaaccaggcaagactttggacctgctggaatgcaaggatatgctccagtcaccggcatgtgtcatccagtgagaagttgtaccctgaatcatgaggatggtttttcatctgcttttgtagtagcccatgaaacgggccatgtgttgggaatggagcatgatggacaaggcaacaggtgtggtgatgagactgctatgggaagtgtcatggctcccttggtacaagcagcattccatcgttaccactggtcccgatgcagtggtcaagaactgaaaagatatatccattcctatgactgtctccttgatgacccttttgatcatgattggcctaaactcccagaacttcctggaatcaattattctatggatgagcaatgtcgttttgattttggtgttggctataaaatgtgcaccgcgttccgaacctttgacccatgtaaacagctgtggtgtagccatcctgataatccctacttttgtaagactaaaaagggacctccacttgatgggactgaatgtgctgctggaaaatggtgctataagggtcattgcatgtggaagaatgctaatcagcaaaaacaagatggcaattgggggtcatggactaaatttggctcctgttctcggacatgtggaactggtgttcgtttcagaacacgccagtgcaataatcccatgcccatcaatggtggtcaggattgtcctggtgttaattttgagtaccagctttgtaacacagaagaatgccaaaaacactttgaggacttcagagcacagcagtgtcagcagcgaaactcccactttgaataccagaataccaaacaccactggttgccatatgaacatcctgaccccaagaaaagatgccacctttactgtcagtccaaggagactggagatgttgcttacatgaaacaactggtgcatgatggaacgcactgttcttacaaagatccatatagcatatgtgtgcgaggagagtgtgtgaaagtgggctgtgataaagaaattggttctaataaggttgaggataagtgtggtgtctgtggaggagataattcccactgccgaaccgtgaaggggacatttaccagaactcccaggaagcttgggtaccttaagatgtttgatataccccctggggctagacatgtgttaatccaagaagacgaggcttctcctcatattcttgctattaagaaccaggctacaggccattatattttaaatggcaaaggggaggaagccaagtcgcggaccttcatagatcttggtgtggagtgggattataacattgaagatgacattgaaagtcttcacaccgatggacctttacatgatcctgttattgttttgattatacctcaagaaaatgatacccgctctagcctgacatataagtacatcatccatgaagactctgtacctacaatcaacagcaacaatgtcatccaggaagaattagatacttttgagtgggctttgaagagctggtctcagtgttccaaaccctgtggtggaggtttccagtacactaaatatggatgccgtaggaaaagtgataataaaatggtccatcgcagcttctgtgaggccaacaaaaagccgaaacctattagacgaatgtgcaatattcaagagtgtacacatccactctgggtagcagaagaatgggaacactgcaccaaaacctgtggaagttctggctatcagcttcgcactgtacgctgccttcagccactccttgatggcaccaaccgctctgtgcacagcaaatactgcatgggtgaccgtcccgagagccgccggccctgtaacagagtgccctgccctgcacagtggaaaacaggaccctggagtgagtgttcagtgacctgcggtgaaggaacggaggtgaggcaggtcctctgcagggctggggaccactgtgatggtgaaaagcctgagtcggtcagagcctgtcaactgcctccttgtaatgatgaaccatgtttgggagacaagtccatattctgtcaaatggaagtgttggcacgatactgctccataccaggttataacaagttatgttgtgagtcctgcagcaagcgcagtagcaccctgccaccaccataccttctagaagctgctgaaactcatgatgatgtcatctctaaccctagtgacctccctagatctctagtgatgcctacatctttggttccttatcattcagagacccctgcaaagaagatgtctttgagtagcatctcttcagtgggaggtccaaatgcatatgctgctttcaggccaaacagtaaacctgatggtgctaatttacgccagaggagtgctcagcaagcaggaagtaagactgtgagactggtcaccgtaccatcctccccacccaccaagagggtccacctcagttcagcttcacaaatggctgctgcttccttctttgcagccagtgattcaataggtgcttcttctcaggcaagaacctcaaagaaagatggaaagatcattgacaacagacgtccgacaagatcatccaccttagaaagatgagaaagtgaaccaaaaaggctagaaaccagaggaaaacctggacaacctctctcttcccatggtgcatatgcttgtttaaagtggaaatctctatagatcgtcagctcattttatctgtaattggaagaacagaaagtgctggctcactttctagttgctttcatcctccttttgttctgcattgactcatttaccagaattcattggaagaaatcaccaaagattattacaaaagaaaaatatgttgctaagattgtgttggtcgctctctgaagcagaaaagggactggaaccaattgtgcatatcagctgactttttgtttgttttagaaaagttacagtaaaaattaaaaagagataccaatggtttacactttaacaagaaattttggatatggaacaaagaattcttagacttgtattcctatttatctatattagaaatattgtatgagcaaatttgcagctgttgtgtaaatactgtatattgcaaaaatcagtattattttaagagatgtgttctcaaatgattgtttactatattacatttctggatgttctaggtgcctgtcgttgagtattgccttgtttgacattctataggttaattttcaaagcagagtattacaaaagagaagttagaattacagctactgacaatataaagggttttgttgaatcaacaatgtgatacgtaaattatagaaaaagaaaagaaacacaaaagctatagatatacagatatcagcttacctattgccttctatacttataatttaaaggattggtgtcttagtacacttgtggtcacagggatcaacgaatagtaaataatgaactcgtgcaagacaaaactgaaaccctctttccaggacctcagtaggcaccgttgaggtgtcctttgtttttgtgtgtgtgtgttcttttttaattttcgcattgttgacagatacaaacagttatactcaatgtactgtaataatcgcaaaggaaaaagttttgggataacttatttgtatgttggtagctgagaaaaatatcatcagtctagaattgatatttgagtatagtagagctttggggctttgaaggcaggttcaagaaagcatatgtcgatggttgagatatttattttccatatggttcatgttcaaatgttcacaaccacaatgcatctgactgcaataatgtgctaataatttatgtcagtagtcaccttgctcacagcaaagccagaaatgctctctccagggagtagatgtaaagtacttgtacatagaattcagaactgaagatatttattaaaagttgattttttttcttgatagtatttttatgtactaaatatttacactaatatcaattacatattttggtaaactagagagacataattagagatgcatgctttgttctgtgcatagagacctttaagcaaactactacagccaactcaaaagctaaaactgaacaaatttgatgttatgcaaacatcttgcatttttagtagttgatattaagttgatgacttgtttcccttcaaggaaacattaaattgtatggactcagctagctgttcaatgaaattgtgaattagaaacatttttaaaagtttttgaaagagataagtgcatcatgaattacatgtacatgagaggagatagtgatatcagcataatgattttgaggtcagtacctgagctgtctaaaaatatattatacaaactaaaatgtagatgaattaacctctcaaagcacagaatgtgcaagaacttttgcattttaatcgttgtaaactaacagcttaaactattgactctatacctctaaagaattgctgctactttgtgcaagaactttgaaggtcaaattaggcaaattccagatagtaaaacaatccctaagccttaagtcttttttttttcctaaaaattcccatagaataaaattctctctagtttacttgtgtgtgcatacatctcatccacaggggaagataaagatggtcacacaaacagtttccataaagatgtacatattcattatacttctgacctttgggctttcttttctactaagctaaaaattcctttttatcaaagtgtacactactgatgctgtttgttgtactgagagcacgtaccaataaaaatgttaacaaaatata

SEQ ID NO: 1008 - DNA, 1961 bp, Homo sapiens
ggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggtgaggccccagtcagcaccgcaggccatgcactgcacaattctaagaagcgccactacatagactatgatgcaaatgatgttcctggagttgtgtgacatggtgccttgccccagccacactgccatgtgtggctacctaggccctgacagtgctgggtcctcagtgcccaggtccccgggaatctggatctcaacccaatggacccaggtgtcttggctgtctatgcaccttctatgatccctctccacaggacctgtgtggagtctccacttgcgacacgctgggtatggctgatgtgggcaccgtctgtgacccggctcggagctgtgccattgtggaggatgatgggctccagtcagccttcactgctgctcatgaactgggtaaagtaggggtggatgagaaaggtattagggaggagaaggtgggggagggggtagcaagttcaccacagtgttaatgggggtcccaaggtattcttcccccaggcctaggtatagggctattactcctctctgctccaggtgtagacatacatttacatttttctattaaataaattagttggtcgaaac

SEQ ID NO: 1009 - DNA, 4333 bp, Homo sapiens
tggggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccaggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccggctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactca

SEQ ID NO: 1010 - DNA, 9056 bp, Homo sapiens
cttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacggtagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggctgtacagccatgctagcatcgagaaccacatccgcctggccgtggtgaaggtggtggtgctaggcgacaaggacaagagcctggaagtgagcaagaacgctgccaccacactcaagaacttttgcaagtggcagcaccaacacaaccagctgggagatgaccatgaggagcactacgatgcagctatcctgtttactcgggaggatttatgtgggcatcattcatgtgacaccctgggaatggcagacgttgggaccatatgttctccagagcgcagctgtgctgtgattgaagacgatggcctccacgcagccttcactgtggctcacgaaatcggacatttacttggcctctcccatgacgattccaaattctgtgaagagacctttggttccacagaagataagcgcttaatgtcttccatccttaccagcattgatgcatctaagccctggtccaaatgcacttcagccaccatcacagaattcctggatgatggccatggtaactgtttgctggacctaccacgaaagcagatcctgggccccgaagaactcccaggacagacctacgatgccacccagcagtgcaacctgacattcgggcctgagtactccgtgtgtcccggcatggatgtctgtgctcgcctgtggtgtgctgtggtacgccagggccagatggtctgtctgaccaagaagctgcctgcggtggaagggacgccttgtggaaaggggagaatctgcctgcagggcaaatgtgtggacaaaaccaagaaaaaatattattcaacgtcaagccatggcaactggggatcttggggatcctggggccagtgttctcgctcatgtggaggaggagtgcagtttgcctatcgtcactgtaataaccctgctcccagaaacaacggacgctactgcacagggaagagggccatctaccgctcctgcagtctcatgccctgcccacccaatggtaaatcatttcgtcatgaacagtgtgaggccaaaaatggctatcagtctgatgcaaaaggagtcaaaacttttgtggaatgggttcccaaatatgcaggtgtcctgccagcggatgtgtgcaagctgacctgcagagccaagggcactggctactatgtggtattttctccaaaggtgaccgatggcactgaatgtaggctgtacagtaattccgtctgcgtccgggggaagtgtgtgagaactggctgtgacggcatcattggctcaaagctgcagtatgacaagtgcggagtatgtggaggagacaactccagctgtacaaagattgttggaacctttaataagaaaagtaagggttacactgacgtggtgaggattcctgaaggggcaacccacataaaagttcgacagttcaaagccaaagaccagactagattcactgcctatttagccctgaaaaagaaaaacggtgagtaccttatcaatggaaagtacatgatctccacttcagagactatcattgacatcaatggaacagtcatgaactatagcggttggagccacagggatgacttcctgcatggcatgggctactctgccacgaaggaaattctaatagtgcagattcttgcaacagaccccactaaaccattagatgtccgttatagcttttttgttcccaagaagtccactccaaaagtaaactctgtcactagtcatggcagcaataaagtgggatcacacacttcgcagccgcagtgggtcacgggcccatggctcgcctgctctaggacctgtgacacaggttggcacaccagaacggtgcagtgccaggatggaaaccggaagttagcaaaaggatgtcctctctcccaaaggccttctgcgtttaagcaatgcttgttgaagaaatgttagcctgtggttatgatcttatgcacaaagataactggaggattcagcactgatgcagtcgtggtgaacaggaggtctacctaacgcacagaaagtcatgcttcagtgacattgtcaacaggagtccaattatgggcagaatctgctctctgtgaccaaaagaggatgtgcactgcttcacgtgacagtggtgaccttgcaatatagaaaaacttgggagttattgaacatcccctgggcttacaagaaacactgatgaatgtaaaatcaggggacatttgaagatggcagaactgtctcccccttgtcacctacctctgatagaatgtctttaatggtatcataatcattttcacccataatacacagtagcttcttcttactgtttgtaaatacattctcccttggtatgtcactttatatcccctggttctattaaaatatccatatatatttctataaaaaaagtgtttgaccaaagtaggtctgcagctatttcaacttccttccgtttccagaaagagctgtggatattttactggaaattaagaacttgctgctgttttaataagatgtagtatattttctgactacaggagataaaatttcagtcaaaaaaccattttgacagcaagtatcttctgagaaattttgaaaagtaaatagatctcagtgtatctagtcacttaaatacatacacgggttcatttacttaaacctttgactgcctgtatttttttcaggtagctagccaaattaatgcataatttcagatgtagaagtagggtttgcgtgtgtgtgtgtgatcatactcaagagtctaaaaactagtttccttgtgttggaaatttaaaaggaaaaaaatcgtatttcactgtgttttcaatttatattttcacaactactttctctctccagagctttcatctgatatctcacaatgtatgatatacgtacaaaacacacagcaagttttctatcatgtccaacacattcaacactggtatacctcctaccagcaagcctttaaaatgcatttgtgtttgcttatttgttttgttcaagggttcagtaagacctacaatgttttgtatttcttgacttattttattagaaacattaaagatcacttggtagttagccacattgagaagtggttatcattgttaatgtggttaatgccaaaaagtggttaatattaataagactgtttccacaccataggcaataatttcttaatttaaaaaatctaagtatattcctattgtactaaatatttttcccaactggaaagcacttgattgtacccgtaagtgtttgagtgatgacatgtgatgattttcagaaagttgttgtttttgtttccatagcctgtttaagtaggttgtaagtttgaatagttagacatggaaattattttataagcacacacctaaagatatctttttagatgataaaatgtacacccccccatcaccaacctcacaacttagaaaatctaagttgtttgatttctttgggatttcttttgttgtgaaacactgcaaagccaatttttctttataaaaattcatagtaatcctgccaaatgtgcctattgttaaagatttgcatgtgaagatcttagggaaccactgtttgagttctacaagctcatgagagtttatttttattataagatgtttttaatataaaagaattatgtaactgatcactatattacatcatttcagtgggccaggaaaatagatgtcttgctgttttcagtattttcttaagaaattgcttttaaaacaaataattgttttacaaaaccaataattatcctttgaattttcatagactgactttgcttttgacgtagaaattttttttctcaataaattatcactttgagaaatgaggcctgtacaaggctgataacctatatgtgatggagatcacccaatgccaagggcagaaagcaaacctagttaaataggtgagaaaaaaaataataatcccagtgccatttgtctgtgcaaagagaattaggagagaggttaatgttacttttttccattttggaaataattttaatcaagtaactcaaatgtgacaaaatttatttttattttttgtggttatattcccaacaacattaaaaaatactcgaggcataaatgtagttgtctcctactctgcttctcttactatactcatacatttttaatatggtttatcaatgattcatgtttccctcaaatagtgatggtttacacctgtcatggaaacaatcctagagagctcagagcaattaaaccactattccatgcttttaagtagttttctccacctttttcttatgagtctcactagattgactgaggaatgtatgtctaaattcctggagaagatgatatggattggaaactgaaattcagagaaatggagtgttcaatagataccacgaattgtgaacaaagggaaaattctatacaactcaatctaagtcagtccactttgacttcgtactgtctttcacctttccattgttgcatcttgaattttttaaaatgtctagaattcaggatgctaggggctacttctttaaaaaaaaaaaaaaaaaagaattcgtctgaaaatgctcaggtttgtaagaatctaatctcacttacataactaagcactccataataagttttattaagtacaaagggagccagaaaaaatgacatttatttcttctagatcagaaaaatttaaattaagccctgccttgctgtttagaaatatgtgggcattgttataatttattcaataaatttatgttcctttgccttcctgtggaaacagttttatcccactaaactaggaattaggggataaatcacaaacaaaaaaaaagttgcagcactgaaaaaaagtaatttattgtttttgcaactggtatgtgaatttgtgtgataaaattatttattcttatttaacaaaaatatgttcaaatttttctatatttaaaatgttttgctgttgtcctactttttaatttatgcttcatgtttgtgtataaagtacacttttacactttgtgagtttacataatatacagcactggttgcttttgtatttttttacagaaagctttctgtgtgaagcaggtgtatatgtatatattcctcatgtattcttattctgatactatcatttttctttccaaggaaattttaatctgtcatgaccaatagtgttcattacttgtgcctatgataataggttttttacatcacattaacactattttttccaagtcacaaataagaaaaacacttattcaatgaaacaaggtgcaagttttaaatttgggtacacaaatagcctagaagcttcctacagacgctaagacacagccaataatcagatcctttcacttcatcgagaaacttggacaagtcgatattgatgtattagatgaaagttgtctacacacaacttctgagggatacaaacgataataaaaccaaatgttgtctgtttctcctttagaaacacctcctaaaattaatatcatttagtctctagtgtctgtaggattctacagatgagcacaaatagattgggtttgtataacaaatgctaatagtcataactgtttctacaaatatggggtgtccattaagagaatgtgatgttttcctactgctgttgaatcccatggggtgattataggacttgaaataggcagagtcacctctgatgacatcagcttgcctctgtgatttcacagtctgatcctggcaacaagacaaagcacccttggacacacagccaatctctggttgtgatatttccccattgattccttccttgttaacaaggtcattttaatggttcaggtgaggacagcagccagattcaaagtccagaatttgtgctgttacatagagttcacactgtcaaataacattgaatttaataatgatcaaatttttctagtagtctttggcagagtgtataatctcattggcatgattggtgaatattactaatctctttataatgaaagatgctttacaaataccttatatttgctaacatttcaaaactactaaataaatgaaatagccatgtgtacagaaatggtcatttaaagctttaatagaaccaaattcaagacaatgtatcatttagacacacagaaaaggaacttgtatgttttccctattatttttctcatttgccaacaatctatagttttaggttatcaaacagatagatcaacttaactggctagtacattgaaaaatcttcctaagaatcctttgttagcataatctatagagataatttctcaaattatatcatcatgatgcatataaactctataatgtataattgtgtttcatttatttaatgtatgagaacatattgaaatacaaaaccatgcattagccaaaaaattggaatacaggtagtgttcagatcagcaaaacattcagtctggtaaatgcctgcctggggctatgatatcattctcaatgcaggttttatggaaaaactaaaagaatatgttgttagatgatgttggttttgaaaaaaaaaagacattaacatacacattagttagcccagttaattgcattctactaatatagttgcacattagcaataattttgctgtctctggtctttattttgtggcttcaactaactggaccatgtggactgtaaaggtcaaatggaaaaaacgagcagtggcccctcatcctgtaaggtactgctacatcagagtgacctaaaagtctaacactgtgaggaaaactgtgatttgtaggaaaaaaaaaaaaaacaaataaaaaacagggcatgctttttaatttttttccactttcctttggcacacccaatgaacaattctaatttttattgaggtgctaacatctttcgtgaccgactgtcaaatgtggtatttttgagttactatttttctacatgattttacagtttgcaagaaagacctctaagctttgtgtcacggtagggcacaacttgatactcaaaatttgaaaaataagcacatccaatgattgttttgaccaacagtggtcagtgacgtaaactgcatgtgcatctgaggacatttaaggggtcattaaaatttgaggagcatcaggccggagtagcagacttttagatgagtcatatttcagcattcactaagtcctcagcattccattcaaactgtcgtgtatatttggcctgattttttttcaagctttgcaataatttatgttattggtaaacacttggtgactatatctcagccttttctttaacaactcacaatatattagaaacacgtctacctatactgagagtatatttacaatagaagaacatactgtatgtgactttgtaaagctagacttttgattaagaaatatataatctctggatgctatttttgcattatacactcaggcacaacgtaaaccttgatggctcatcttgctacaattacgagttgaaaaacactacttacgtatttgtatgacctattagtcagaggaaatcatacatatgctttgtaaatagactttgcagataactaaatagactgaagaaatatgttgcatttgatagaagcaattgcataaatatttggtttctatattagagtctgtgagtaaagtcaagtaataaacctaagtaggtataacagatttttaaaccttgaaacttgctttgatggtagagaaaatcattgaagatttacatactgtatataagatgtaaaatgtacgctgcttattaccctcaattttccagaagcaatggtatataatgcagttgaaaaaccaaaaatcttggaaaactaagacgggtcttgtttaaaatgtctctcagctttggcaaccttcaaatcttaatcaactatttaaagcattactgtgtcttgtagcctgcattccacaacagctctgttattcaggtaaaagacttgaactgagccgtttgggacctatactgtaatattttcattgaggaacaatatcctattttgtaaagcatttccctatgtgtgactttaaactgtaaaattaaacactgcttttgtgggttcagtgggcataataaatataaattgtaaactaggttaaagta

SEQ ID NO: 1011 - DNA, 3391 bp, Homo sapiens
gctgcaattcaagttggctgggggccggtagtgagatctagggctacttcaacaaaactttgctgcccttcctgctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggcaaaaaataaaaaaataaaaaaaattaaaaaaagttagagaggagagggagtacgtgagtcgtccagtgcaatctctattgtctgaaacttactttttatcagaatttgaagatgaaaacggttaaaaaatggccatactttagtaactaatcagcctaatgctttgcttatgaaaacttttaccatcattatttttttcattttggattgagaaaatgaatccagatatagaagaaagtgcaggatgttggataaaagtggctcttaaacagtggaacatccaataactaatttgcaagaagttttaaagaaataaaattgttatgcttcgattttggtatggtattgactctttagcacataggtagccctcaaaaaaatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtcgaaaggtcatgaagcagcaatatggcagctcacattactgcgaataccaatcctttttcctggtctgcttgcagtcgagactacatcaccagctttctagagaagtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggaggggacggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtaagatgcccactaggcagcccacccagagggcaagatggagaacaaaacacattctgagctatgctttgtgtttgttaaaaaagctaattggaaacatttcttgcaggtttgcttcaagctgtaatttagcaaaagaaactttgctttaa

SEQ ID NO: 1012 - DNA, 7311 bp, Homo sapiens
agtgtgctctgcctccgaggaaaagctgccaaaattttctcctgctgcaattcaagttggctgggggccggtagtgagatctagggctacttcaacaaaactttgctgcccttcctgctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggcaaaaaataaaaaaataaaaaaaattaaaaaaagttagagaggagagggagtacgtgagtcgtccagtgcaatctctattgtctgaaacttactttttatcagaatttgaagatgaaaacggttaaaaaatggccatactttagtaactaatcagcctaatgctttgcttatgaaaacttttaccatcattatttttttcattttggattgagaaaatgaatccagatatagaagaaagtgcaggatgttggataaaagtggctcttaaacagtggaacatccaataactaatttgcaagaagttttaaagaaataaaattgttatgcttcgattttggtatggtattgactctttagcacataggtagccctcaaaaaaatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagattcaggccgtggtacttgccttgataatgagcctcccaagcgtgactttctttatccagctgtggccccaggtcaggtgtatgatgctgatgagcaatgtcgtttccagtatggagcaacctcccgccaatgtaaatatggggaagtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggaggggacggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtgtccaaagacaggaggtggtctgtaaaaggttggatgacaactccattgtccagaacaattactgtgatcctgacagtaagccacctgaaaatcaaagagcctgcaacactgagccctgcccacctgagtggttcattggggattggttggaatgcagcaagacttgtgatggtgggatgcgcacaagggcagtgctctgcatcaggaagatcggaccttctgaggaggagacgctggactacagtggttgtttaacacaccggcctgtcgaaaaagagccctgcaacaaccagtcatgtccaccacagtgggtggctttggactggtctgagtgtactccaaaatgtggtccaggattcaagcatcggattgttctgtgcaagagcagtgacctttctaagacattcccagctgcacaatgtccagaggaaagcaaacctcctgtccgcatccgctgcagtttgggccgctgccctcctcctcgctgggtcacaggagactggggccagtgttctgctcagtgtggccttggacagcagatgagaactgtgcagtgtctctcctacaccggacaggcatctagtgactgtctagaaactgttcggcctccatcaatgcagcagtgtgaaagcaaatgtgacagtacccccatttctaatactgaagagtgcaaagatgtgaataaagtggcttattgcccactggtgctgaagttcaagttctgcagtcgagcatacttcagacagatgtgttgtaagacctgccaaggacactgacccacagaaagccagagagagtgccttgtcatttcatcatggaaatgcatccatcaaagagagccacccagaggaagaggattgatgtccttgcaaatgcattaccctgtggaaaacgtaaccactggtcagccctagctgacaaaatttcaatattattttagcttctgtgaagtgggatttattgatccaaagtgctggacacggtattaggagggaatgccagattggagagatccaaacaacacagggagacttgcttactgtggagcgtttgtgttctttcgagtaaatccaatagcctgtttacctccttggaccattaagataatttttattatggacttagcaatgacactgaatccatttgtatttaaaactgtttaaaatgtagctgttatgacttggtcaactatggaagtgaagaaggttcagaattcttaagtcatagcttaaaaatatttactgtactttatctcactacaacagcaccacaatttaaattataaaacgggctttgaactataatttaaggagcaattataaatcaaaagtaatgaaagtttgtattatttttcttcattccacttaatttccttaggaataatcccctggttctgaacactgctgtgagccatatataaaactatattaaactgaacaataatgaggggcatagtttaaagcagtgcatcagttactgcagctgtgcaagtctataaactcagtgctgaaagactgtggccaacttgccattgtgcaagtaaagctgagatttccattaaaactttaagagaaaaacatttcaatttcatgcagaaaccagacctggggtatggtacagaccaaaggaccaggccctttgctgccaccacacaggatgccttagttcttatttgagtccctccaactcacttgtgtttacatcctccccagccacagcacggcttctgccctttggattgctgcacgtgtgttgagcttactgagatgataccatgcaaaagatagactggctcggtaaccaggcagacccttttgcagtttgttgacaattacgatgagttccagatgtcccttctttgatatggtagaagggcatttatttatatgagagcaaatgtgtgtgtgtgtttgcgggcgcttttaagtgtgtggatagatgagtgtgcttgcacataatgtgctatttctgtgagttttaaagtaggcaagggataataaccaaagaagaaaatttcatgaagactagacatcataaagcataattttaatagtcactcaaccaagtattttttattttttatggatactctgaatggcaattaaatgtgaaacccagtttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacaccatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatgttttctgcactctcagtcatgaccatctgtatcttgttacctgctttctctctcaacaccacagttctcaaccctgagccttccagagagagctattgatgatacaagaggaatcaccagggcccggatctaagatgcccttagaagaccagcccaagtgccgtcttagccattcagtgaagggcaaacagcccatgggtagtatggcccgagcactgaattcccttgcgccttttcaaagaacagttaacttggtgctaatgtgccctggtgaaataaataaaagatgggcagtttctgtggcattttaggcataggtttgcaatccagatctgattttctccaacataaatatcagctcatgttcttatttcaaaaagatttcttattaccgactaaaagctattttttacctcacctggaaactaccattgtgagggccatcccccaggcactgcacagcaccttggctgatgctggaagaggagggcagtcagtgtcacttctgggatgtgccccagcactgagaacaaaatgcaggcatcccccggggcagcatcagagtgcctttctagagggagccacgcacagaatgtaacaggatgaaacagtttcaagtaagccttgaattgaaacctgagtaggttaaaacaattctatttcatagcacatcacaatactgctgctactctgtagccacccccatggctacatgatgccctattcctaaataataacaatagcattgtcagtggaggctgggccaccatggcagaccttccaaaagtagtgagctacatagactacttagggaaccccagggaaactggtaccctacacctgggagcagtatctgccactgggataaagtcctactaaaaaaggaacggtaaatgtaccctaatgattaaaccccgtgagatacatatgatttccaaatagtccatttcattaggaacttttttgtttgaatgaatgtcacataggtatcctcagtaacacagaacgaaattacctttgtattattgtgattagttgttgcttattattttatactcagtaataatgtggtacactgttaatttttttgcttttgtaaattatattctaatttattgccatgtttcctaacacttgtcctacattcattctcctgcttgtaatgaaaatgaaaaaatcattgtaacacttgatggagtgaaattccacgccaggcacagaatttttttgacatagataatttagtaaaataaaaattcagcttataataatgata

SEQ ID NO: 1013 - DNA, 2221 bp, Homo sapiens
gctgcaattcaagttggctgggggccggtagtgagatctagggctacttcaacaaaactttgctgcccttcctgctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggcaaaaaataaaaaaataaaaaaaattaaaaaaagttagagaggagagggagtacgtgagtcgtccagtgcaatctctattgtctgaaacttactttttatcagaatttgaagatgaaaacggttaaaaaatggccatactttagtaactaatcagcctaatgctttgcttatgaaaacttttaccatcattatttttttcattttggattgagaaaatgaatccagatatagaagaaagtgcaggatgttggataaaagtggctcttaaacagtggaacatccaataactaatttgcaagaagttttaaagaaataaaattgttatgcttcgattttggtatggtattgactctttagcacataggtagccctcaaaaaaatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagaatttcttaaactcggtgattcaataagtggttcatga

SEQ ID NO: 1014 - DNA, 5489 bp, Homo sapiens
cttttctttgcctctgcagcggccaagggggcgggccctgcagcctttgttgcccgcggaccgagcgcagccgaacggagtcggggccgggtcgccgggagctgcacgccggccgggcatgtcctgagccggacctgggaccaggcagcgaccggacgggacggacgagagcgtgcgcgcggggtcacccggcggccgcccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccgagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggcctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgtgcagaggcagaatgtgtactgcttggagcggcaggcagggcccgtggacgaggagcactgtgaccccctgggccggcctgatgaccaacagaggaagtgcagcgagcagccctgccctgccaggtggtgggcaggtgagtggcagctgtgctccagctcctgcgggcctgggggcctctcccgccgggccgtgctctgcatccgcagcgtggggctggatgagcagagcgccctggagccacccgcctgtgaacaccttccccggccccctactgaaaccccttgcaaccgccatgtaccctgtccggccacctgggctgtggggaactggtctcagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctggccccacgcccttcacccgcctcatcacccaagccaggcaccatgggcaacgccattgaggaggaggctccagagctggacctgccggggcccgtgtttgtggacgacttctactacgactacaatttcatcaatttccacgaggatctgtcctacgggccctctgaggagcccgatctagacctggcggggacaggggaccggacacccccaccacacagccatcctgctgcgccctccacgggtagccccgtgcctgccacagagcctcctgcagccaaggaggagggggtactgggaccttggtccccgagcccttggcctagccaggccggccgctccccacccccaccctcagagcagacccctgggaaccctttgatcaatttcctgcctgaggaagacacccccataggggccccagatcttgggctccccagcctgtcctggcccagggtttccactgatggcctgcagacacctgccacccctgagagccaaaatgatttcccagttggcaaggacagccagagccagctgccccctccatggcgggacaggaccaatgaggttttcaaggatgatgaggaacccaagggccgaggagcaccccacctgcccccgagacccagctccacgctgccccctttgtcccctgttggcagcacccactcctctcctagtcctgacgtggcggagctgtggacaggaggcacagtggcctgggagccagctctggagggtggcctggggcctgtggacagtgaactgtggcccactgttggggtggcttctctccttcctcctcccatagcccctctgccagagatgaaggtcagggacagttccctggagccggggactccctccttcccaaccccaggaccaggctcatgggacctgcagactgtggcagtgtgggggaccttcctccccacaaccctgactggcctcgggcacatgcctgagcctgccctgaacccaggacccaagggtcagcctgagtccctcagccctgaggtgcccctgagctctaggctgctgtccacaccagcttgggacagccccgccaacagccacagagtccctgagacccagccgctggctcccagcctggctgaagcggggccccccgcggacccgttggttgtcaggaacgccggctggcaagcgggaaactggagcgagtgctctaccacctgtggcctgggtgcggtctggaggccggtgcgctgtagctccggccgggatgaggactgcgcccccgctggccggccccagcctgcccgccgctgccacctgcggccctgtgccacctggcactcaggcaactggagtaagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcagctggtacacatcttcctggagggagtgctccgaggcctgtggcggtggtgagcagcagcgtctagtgacctgcccggagccaggcctctgcgaggaggcgctgagacccaacaccacccggccctgcaacacccacccctgcacgcagtgggtggtggggccctggggccagtgctcaggcccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgctgtgagcgggaccgcctgtccttcgggttctgcgagacgctgcgcctactgggccgctgccagctgcccaccatccgcacccagtgctgccgctcgtgctctccgcccagccacggcgccccctcccgaggccatcagcgggttgcccgccgctgactgcgccaggatgcacagaccgaccgacagacctcagtgcccaccacgggctgtggcggagctcccgccccctgcgccctaatggtgctaaccccctctcactacccagcagcaggctggggacctcctccccctcaaaaaaggtatttttttattctaacagtttgtgtaacatttattatgattttacataaatgagcatctaccattccaaagc

SEQ ID NO: 1015 - DNA, 1758 bp, Homo sapiens
tttctttctttctctccttctagctctcttgtcttttctttgcctctgcagcggccaagggggcgggccctgcagcctttgttgcccgcggaccgagcgcagccgaccggacgggacggacgagagcgtgcgcgcggggtcacccggcggccgcccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagctcctgtacgacgccgctcccctcacctggtcccgctgcagccgccagtatatcaccaggttccttgagtgtgcagaggcagaatgtgtactgcttggagcggcaggcagggcccgtggacgaggagcactgtgaccccctgggccggcctgatgaccaacagaggaagtgcagcgagcagccctgccctgccagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctg

SEQ ID NO: 1016 - DNA, 4010 bp, Homo sapiens
acagggtcgctgagaccagtgcacgagcctcttcggaagatgcatcctggactcttggccgcagaggagaaagcggttggggtctcccagggactctttctaaagggtcagtccagcatggtaggggttaacgtgggtccacgcgtagagggaaaggaaagaagttgtagttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggccgagtcggccttgcacccgattgattccgcttttcctggagagagcggccgggccgcgctcgggccgccagcacctgcccgcgcctggcgggcttcttccctctcctgcgcgcagccaccgccgcagcccccatgctccccgcccccgccgccccccggtggcctccgctcctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgctgcgcctggcgcccgacgacagcttcctagcgcccgagttcaagatcgagcgcctcgggggctccggccgggcgaccgggggcgagcgggggctgcgcggctgcttcttctccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggagactgtctcctggatgcccctgctgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaagcccgtggcagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacgggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaattatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaagggtctccactgtggtgactgggtcccttggccatatcaaggcagcacggcccacccaggcctcccattgccgcaacccctccagtactgcacaaattcctaagggggaagaggagagggtatggggcggcagaccctatcatcaactgtccagtggactggaccttgctcgggttcaagtagagggcataggttaaaaggtaaaagtgcacttattgactcagacaggacactcagcgtcagtctgtttgcaaaggactagcaaacttaaatgaaaaaaaaaattctatctggtttccccgataaataatctacctcacaggggaaaaaattagtacaagagaggcgtggggcagggagtcaatggtgaatgtcaaagcaggctccaaagctggaccccaagctgtcttcaagaatgaccacgactgtcttcagtgttaaaatccatcacctaaagggccgcagcgtcgcagggtttggagagccacatgttctcaggctgccacctgcaggggtggatccatttcaagtatttatgcaaatgtgtctctgaactaaagtgtgatcttatgcc

SEQ ID NO: 1017 - DNA, 3390 bp, Homo sapiens
gctgctcgcgctcggctcgggggcggcggcgcgggaggagcgggctgcgccagccagaggggccgccgggggagcgctcccgccgccgggccccgcgggccgagtcggccttgcacccgattgattccgcttttcctggagagagcggccgggccgcgctcgggccgccagcacctgcccgcgcctggcgggcttcttccctctcctgcgcgcagccaccgccgcagcccccatgctccccgcccccgccgccccccggtggcctccgctcctgctgctgctgctgctgctgctgccgctggcccgcggcgccccggcccggcccgcagccggggggcaggcctcggagctggtggtgcccacgcggttgcccggctgcgcggctgcttcttctccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggagactgtctcctggatgcccctgctgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaagcccgtggcagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacgggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaattatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaagggtctccactgtggtgactgggtcccttggccatatcaaggcagcacggcccacccaggcctcccattgccgcaacccctccagtactgcacaaattcctaagggggaagaggagagggtatggggcggcagaccctatcatcaactgtccagtggactggaccttgctcgggttcaagtagagggcataggttaaaaggtaaaagtgcacttattgactcagacaggacactcagcgtcagtctgtttgcaaaggactagcaaacttaaatgaaaaaaaaaattctatctggtttccccgataaataatctacctcacaggggaaaaaattagtacaagagaggcgtggggcagggagtcaatggtgaatgtcaaagcaggctccaaagctggaccccaagctgtcttcaagaatgaccacgactgtcttcagtgttaaaatccatcacctaaagggccgcagcgtcgcagggtttggagagccacatgttctcaggctgccacctgcaggggtggatccatttcaagtatttatgcaaatgtgtctctgaactaaagtgtgatcttatgcc

SEQ ID NO: 1018 - DNA, 7060 bp, Homo sapiens
ggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaa

SEQ ID NO: 1019 - DNA, 3168 bp, Homo sapiens
gtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggaaaattgcctccagctgcatccatattgctgcaaaggacatgatttcattattttttatggctgcatagtatttcatcatgtatacagaccacatttttaaaatccagtccaccattaatcggtacctaggttgattccacgtttgctattgtgaatagtgctgcaataaacatgtgagtgcaggtg

SEQ ID NO: 1020 - DNA, 7464 bp, Homo sapiens
acagggcgcccggcgcgcctcggagcgcaagttcctcgccttctcctgcccgctcgctgggcattatgcggccaagcagccgagccccagtcctcctcctcctcctgctcctccggctcctcctgcggcccgagcggctcagctctcggcaggcggcggcgttgctcagccgagcgcagacgggaccctcgcagcgagacctcagcgactcctaaagtcaaaagttggcggcgggcgccgggctccgcgcgctctccacggccgctgcctcgcgtcgccgccgcagccaaggagggcaggagggaggggggtgggggcagcggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaa

SEQ ID NO: 1021 - DNA, 2044 bp, Homo sapiens
aagataaaactggacactggggagaccacaacttcatgctgcgtgggatctcccagctacctgcagtggccaccatgtcttgggtcctgctgcctgtactttggctcattgttcaaactcaaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcaagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 1022 - DNA, 2348 bp, Homo sapiens
agatgtgagtcctcaatgagctataaccacagccataaatatctctcaaagatgaggaacattctcatgatgttgacactgcaattttttgacaatttcccaacactcttaagaaacattccccaatctcacacgaaaagtgggggttttaattttcttgttcaacttctaaagagaaattggagaagataaaactggacactggggagaccacaacttcatgctgcgtgggatctcccagctacctgcagtggccaccatgtcttgggtcctgctgcctgtactttggctcattgttcaaactcaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcaagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 1023 - DNA, 2438 bp, Homo sapiens
agatgtgagtcctcaatgagctataaccacagccataaatatctctcaaagatgaggaacattctcatgatgttgacactgcaattttttgacaatttcccaacactcttaagaaacattccccaatctcacacgaaaagtgggggttttaattttcttgttcaacttctaaagagaaattggagaagataaaactggacactggggagaccacaacttcatgctgcgtgggatctcccagctacctgcagtggccaccatgtcttgggtcctgctgcctgtactttggctcattgttcaaactcaagcctcaaactgtgcgtggcctaaagtcagcattcaataaatatttgtgaaatgaatatttcagttttcacataaaagaaatatcagagaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcaagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 1024 - DNA, 2253 bp, Homo sapiens
atggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgttcatcccagaggcctggtcggcctgcacagtcacctgtggtgtggggacccaggtgcgaatagtcaggtgccaggtgctcctgtctttctctcagtccgtggctgacctgcctattgacgagtgtgaagggcccaagccagcatcccagcgtgcctgttatgcaggcccatgcagcggggaaattcctgagttcaacccagacgagacagatgggctctttggtggcctgcaggatttcgacgagctgtatgactgggagtatgaggggttcaccaagtgctccgagtcctgtggaggaggtgtccaggaggctgtggtgagctgcttgaacaaacagactcgggagcctgctgaggagaacctgtgcgtgaccagccgccggcccccacagctcctgaagtcctgcaatttggatccctgcccagcaagaagcagtatcgactcagcatggaacgcctgcaacgttctttgttaggcaaccaagaggcctggcttctcatcctgctgtcaccaactagctctgtggcctagggcgaggtgtctgccctttatgtttccacatctgcaaagtgaactggttgtacctgatgatctgagatcccatgacttgctcacatgtcccatgattctttattttgtaggcagaagcattaaacagctactcctgctgctgtgt

SEQ ID NO: 1025 - DNA, 3800 bp, Homo sapiens
atgtgtttgactgatgagtggggtttttttttttttttcttcctaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctagatcccccccaagtccccacacagttggaagacatcagggccttgctcgctgccactggaccgaaccttccttcagtgctgacgtctcctctgggaacacagctggtcctggatcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagattactggtggtctgtggacagactggcaacctgctcagcctcctgtggtaaccggggggttcagcagccccgcttgaggtgcctgctgaacagcacggaggtcaaccctgcccactgcgcagggaaggttcgccctgcggtgcagcccatcgcgtgcaaccggagagactgcccttctcggtggatggtgacctcctggtctgcctgtacccggagctgtgggggaggtgtccagacccgcagggtgacctgtcaaaagctgaaagcctctgggatctccacccctgtgtccaatgacatgtgcacccaggtcgccaagcggcctgtggacacccaggcctgtaaccagcagctgtgtgtggagtgggccttctccagctggggccagtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcggacagaacctaagctttcttcattttatttatttatttccccctccccactccacacacacccttccaacctcctccacctccaccttcaagcataaggacgtccgcgtgttttctctttcagttagctggaggacaggatgttgggaaaggaaaggacagatgtctaaaggaggttgcagagcaggccaggcagacagtgggggctcccttgaagagcttcctccctcccaaacctgggtctcaaagacctagaaagaggcaggcacagcccctgcggacagcagggagccagaaggtttgtagcctattggtgcaaacattggacaaattcctgtgtctttcctagaagcgcactatcacaaacacaggagtgttttgctcctttgtctcctcttccccatctatgtccctttagtcacagttaggacaaatggggaggggacaccatgctgaggcagaaactagcccagaactcactcagttcttctagtgggtgagtgcagagagagaagaactcagatcaccagtagggagaggtaaaaaagcaaacaaagcaggctctaaggcacacaacattgcagaaaatgaggaagggaggggagggaagggacagaagcaaaaaggagcctgtggtgttccccagtggggcagggtgagcaggggcttccaggctgcatgaggctcatggaccagctctgatcccatgcatgtgcgcatgctcagagccctgctgcccacaacagagcactgcgctgcgtgggagtccccacttcccaagctatcagagtcaacgtcctgcctgtgcagctgcagcaaagccagtgagaggtgggtctcgccatgcagtaaggccaccctggcacctctttatctaaatccgaagtcccctagccccgcactaactaactgctgctgtgggccagggccattttgagcatgaatggcccaggttttttgccttctaggacctttgctgctccaccgaagggccagggactatggttaacttatcaacatcaacccattaactagtcactgtgccagagagtatctgtcaggctgtcaggttgtagcaacctcttcattccagagctggcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgtaaagtctgtttaaaataaaaaagaatgttttctatgtctgtatatcttttgtgaatatttattaggatttcttattaaaaaagtgcaatattaataattgtacattgtcatccagaaacaaaactattggggggactttattaactaacttcctgcagttgtgttcctgtaaactcagtagtgattattatatttttcctatttttaatagaacctggtgtttaactctggatccattcactgtacaggatgtgttgtaaaaactaacatgggatgctgaggcagtaagagggaattcatttgtggcataatagttatgcatggaatgataaagacagacaaattccatactactactaatgtggttaattatttctagttcgatagtgattgaaaatcagtggtcactatttacatttcctaaagagcaagcatcctccagctccatgttgggttggagcagttggcagtgggtctcagtgagctggcagaacctaggtttgggtgggaagcagaatgctcgttgcatgaaatgaatgtacatttaatgtttgttctgtgaattgcaactcagcagcaccacaagacaatgaaggctgctggctaatgtggaaggaggcactttctcctctaaaacacaaaactgtatttgtattttttgtacagataatacagcttatttattt

SEQ ID NO: 1026 - DNA, 1864 bp, Homo sapiens
aaatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgtaagttgtaaaagcacagactgttctatatttgaaactgttttgtttaaagaaagcagtgtctcactggttgtagctttcatgggttctgaactaagtgtaatcatctcaccaaagctttttggctctcaaattaaagattgattagtttcaaaaa

SEQ ID NO: 1027 - DNA, 3592 bp, Homo sapiens
atgtgtttgactgatgagtggggtttttttttttttttcttcctaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctagatcccccccaagtccccacacagttggaagacatcagggccttgctcgctgccactggaccgaaccttccttcagtgctgacgtctcctctgggaacacagctggtcctggatcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagattactggtggtctgtggacagactggcaacctgctcagcctcctgtggtaaccggggggttcagcagccccgcttgaggtgcctgctgaacagcacggaggtcaaccctgcccactgcgcagggaaggttcgccctgcggtgcagcccatcgcgtgcaaccggagagactgcccttctcgtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcggacagaacctaagctttcttcattttatttatttatttccccctccccactccacacacacccttccaacctcctccacctccaccttcaagcataaggacgtccgcgtgttttctctttcagttagctggaggacaggatgttgggaaaggaaaggacagatgtctaaaggaggttgcagagcaggccaggcagacagtgggggctcccttgaagagcttcctccctcccaaacctgggtctcaaagacctagaaagaggcaggcacagcccctgcggacagcagggagccagaaggtttgtagcctattggtgcaaacattggacaaattcctgtgtctttcctagaagcgcactatcacaaacacaggagtgttttgctcctttgtctcctcttccccatctatgtccctttagtcacagttaggacaaatggggaggggacaccatgctgaggcagaaactagcccagaactcactcagttcttctagtgggtgagtgcagagagagaagaactcagatcaccagtagggagaggtaaaaaagcaaacaaagcaggctctaaggcacacaacattgcagaaaatgaggaagggaggggagggaagggacagaagcaaaaaggagcctgtggtgttccccagtggggcagggtgagcaggggcttccaggctgcatgaggctcatggaccagctctgatcccatgcatgtgcgcatgctcagagccctgctgcccacaacagagcactgcgctgcgtgggagtccccacttcccaagctatcagagtcaacgtcctgcctgtgcagctgcagcaaagccagtgagaggtgggtctcgccatgcagtaaggccaccctggcacctctttatctaaatccgaagtcccctagccccgcactaactaactgctgctgtgggccagggccattttgagcatgaatggcccaggttttttgccttctaggacctttgctgctccaccgaagggccagggactatggttaacttatcaacatcaacccattaactagtcactgtgccagagagtatctgtcaggctgtcaggttgtagcaacctcttcattccagagctggcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgtaaagtctgtttaaaataaaaaagaatgttttctatgtctgtatatcttttgtgaatatttattaggatttcttattaaaaaagtgcaatattaataattgtacattgtcatccagaaacaaaactattggggggactttattaactaacttcctgcagttgtgttcctgtaaactcagtagtgattattatatttttcctatttttaatagaacctggtgtttaactctggatccattcactgtacaggatgtgttgtaaaaactaacatgggatgctgaggcagtaagagggaattcatttgtggcataatagttatgcatggaatgataaagacagacaaattccatactactactaatgtggttaattatttctagttcgatagtgattgaaaatcagtggtcactatttacatttcctaaagagcaagcatcctccagctccatgttgggttggagcagttggcagtgggtctcagtgagctggcagaacctaggtttgggtgggaagcagaatgctcgttgcatgaaatgaatgtacatttaatgtttgttctgtgaattgcaactcagcagcaccacaagacaatgaaggctgctggctaatgtggaaggaggcactttctcctctaaaacacaaaactgtatttgtattttttgtacagataatacagcttatttattt

SEQ ID NO: 1028 - DNA, 8030 bp, Homo sapiens
tttcccttctcgctctgctgctcgctcgcctttctttttcgtccttttcccccttttttgctcgcaccgttacactttctctgtcctcctggctttgttattcagcatgtctgattagcaggagcctgattggctggctgcctgctccgagagagattccattcagcttaccccccacccatccacccacccacccctcggtcaggaaatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgttcatcccagaggcctggtcggcctgcacagtcacctgtggtgtggggacccaggtgcgaatagtcaggtgccaggtgctcctgtctttctctcagtccgtggctgacctgcctattgacgagtgtgaagggcccaagccagcatcccagcgtgcctgttatgcaggcccatgcagcggggaaattcctgagttcaacccagacgagacagatgggctctttggtggcctgcaggatttcgacgagctgtatgactgggagtatgaggggttcaccaagtgctccgagtcctgtggaggaggtgtccaggaggctgtggtgagctgcttgaacaaacagactcgggagcctgctgaggagaacctgtgcgtgaccagccgccggcccccacagctcctgaagtcctgcaatttggatccctgcccagcaaggtgggaaattggcaagtggagtccatgtagtctcacatgtggggtcggcctacagaccagagacgtcttctgcagccacctgctttccagagagatgaatgaaacagtcatcctggctgatgagctgtgtcgccagcccaagcccagcacggtgcaagcttgtaaccgctttaattgccccccagcctggtaccctgcacagtggcagccgtgttccagaacgtgtggcgggggtgttcagaaacgtgaggttctttgcaagcagcgcatggctgatggcagcttcctggagcttcctgagaccttctgttcagcttcaaaacctgcctgccagcaagcatgcaagaaagatgactgtcccagcgagtggcttctctcagactggacagagtgttccacaagctgcggggaaggcacccagactcgaagcgccatttgccgaaagatgctgaaaaccggcctctcaacggttgtcaattccaccctgtgcccgcccctgcctttctcttcctccatcaggccctgtatgctggcaacctgtgcaaggcccgggcggccatccacgaagcacagcccgcacatcgcggccgccaggaaggtctacatacagactcgcaggcagaggaagctgcacttcgtggtggggggcttcgcctacctgctccccaagacggcggtggtgctgcgctgcccggcgcgcagggtccgcaagcccctcatcacctgggagaaggacggccagcacctcatcagctcgacgcacgtcacggtggcccccttcggctatctcaagatccaccgcctcaagccctcggatgcaggcgtctacacctgctcagcgggcccggcccgggagcactttgtgattaagctcatcggaggcaaccgcaagctcgtggcccggcccttgagcccgagaagtgaggaagaggtgcttgcggggaggaagggcggcccgaaggaggccctgcagacccacaaacaccagaacgggatcttctccaacggcagcaaggcggagaagcggggcctggccgccaacccggggagccgctacgacgacctcgtctcccggctgctggagcagggcggctggcccggagagctgctggcctcgtgggaggcgcaggactctgcggaaaggaacacgacctcggaggaggacccgggtgcagagcaagtgctcctgcacctgcccttcaccatggtgaccgagcagcggcgcctggacgacatcctggggaacctctcccagcagcccgaggagctgcgcgacctctacagcaagcacctggtggcccagctggcccaggagatcttccgcagccacctggagcaccaggacacgctcctgaagccctcggagcgcaggacttccccagtgactctctcgcctcataaacacgtgtctggcttcagcagctccctgcggacctcctccaccggggacgccgggggaggctctcgaaggccacaccgcaagcccaccatcctgcgcaagatctcagcggcccagcagctctcagcctcggaggtggtcacccacctggggcagacggtggccctggccagcgggacactgagtgttcttctgcactgtgaggccatcggccacccaaggcctaccatcagctgggccaggaatggagaagaagttcagttcagtgacaggattcttctacagccagatgattccttacagatcttggcaccagtggaagcagatgtgggtttctacacttgcaatgccaccaatgccttgggatacgactctgtctccattgccgtcacattagcaggaaagccactagtgaaaacgtcacgaatgacagtgatcaacacggagaagcctgcagtcacagtcgatataggaagcaccatcaaaacagtgcagggagtgaatgtgacaatcaactgccaggttgcaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctagatcccccccaagtccccacacagttggaagacatcagggccttgctcgctgccactggaccgaaccttccttcagtgctgacgtctcctctgggaacacagctggtcctggatcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagattactggtggtctgtggacagactggcaacctgctcagcctcctgtggtaaccggggggttcagcagccccgcttgaggtgcctgctgaacagcacggaggtcaaccctgcccactgcgcagggaaggttcgccctgcggtgcagcccatcgcgtgcaaccggagagactgcccttctcggtggatggtgacctcctggtctgcctgtacccggagctgtgggggaggtgtccagacccgcagggtgacctgtcaaaagctgaaagcctctgggatctccacccctgtgtccaatgacatgtgcacccaggtcgccaagcggcctgtggacacccaggcctgtaaccagcagctgtgtgtggagtgggccttctccagctggggccagtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcggacagaacctaagctttcttcattttatttatttatttccccctccccactccacacacacccttccaacctcctccacctccaccttcaagcataaggacgtccgcgtgttttctctttcagttagctggaggacaggatgttgggaaaggaaaggacagatgtctaaaggaggttgcagagcaggccaggcagacagtgggggctcccttgaagagcttcctccctcccaaacctgggtctcaaagacctagaaagaggcaggcacagcccctgcggacagcagggagccagaaggtttgtagcctattggtgcaaacattggacaaattcctgtgtctttcctagaagcgcactatcacaaacacaggagtgttttgctcctttgtctcctcttccccatctatgtccctttagtcacagttaggacaaatggggaggggacaccatgctgaggcagaaactagcccagaactcactcagttcttctagtgggtgagtgcagagagagaagaactcagatcaccagtagggagaggtaaaaaagcaaacaaagcaggctctaaggcacacaacattgcagaaaatgaggaagggaggggagggaagggacagaagcaaaaaggagcctgtggtgttccccagtggggcagggtgagcaggggcttccaggctgcatgaggctcatggaccagctctgatcccatgcatgtgcgcatgctcagagccctgctgcccacaacagagcactgcgctgcgtgggagtccccacttcccaagctatcagagtcaacgtcctgcctgtgcagctgcagcaaagccagtgagaggtgggtctcgccatgcagtaaggccaccctggcacctctttatctaaatccgaagtcccctagccccgcactaactaactgctgctgtgggccagggccattttgagcatgaatggcccaggttttttgccttctaggacctttgctgctccaccgaagggccagggactatggttaacttatcaacatcaacccattaactagtcactgtgccagagagtatctgtcaggctgtcaggttgtagcaacctcttcattccagagctggcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgtaaagtctgtttaaaataaaaaagaatgttttctatgtctgtatatcttttgtgaatatttattaggatttcttattaaaaaagtgcaatattaataattgtacattgtcatccagaaacaaaactattggggggactttattaactaacttcctgcagttgtgttcctgtaaactcagtagtgattattatatttttcctatttttaatagaacctggtgtttaactctggatccattcactgtacaggatgtgttgtaaaaactaacatgggatgctgaggcagtaagagggaattcatttgtggcataatagttatgcatggaatgataaagacagacaaattccatactactactaatgtggttaattatttctagttcgatagtgattgaaaatcagtggtcactatttacatttcctaaagagcaagcatcctccagctccatgttgggttggagcagttggcagtgggtctcagtgagctggcagaacctaggtttgggtgggaagcagaatgctcgttgcatgaaatgaatgtacatttaatgtttgttctgtgaattgcaactcagcagcaccacaagacaatgaaggctgctggctaatgtggaaggaggcactttctcctctaaaacacaaaactgtatttgtattttttgtacagataatacagcttatttatttaaa

SEQ ID NO: 1029 - DNA, 2321 bp, Homo sapiens
gcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccaggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccggtaactgtgccttctttctttgttcattaggagagtaagtccactcttccctctcatcatcatggccccaccgggtaccctgagcagctccacactcttcttgaggtgtctagaagcctaccagcttagctcctggagtaggaatgccccaaatccagcatgaccaaaagtaaatgatgtttttttaaagtgtctttcttcaagtttcttcaagaagcctctattgttccccagataatgttccctcaaatagcacggggaagcaactgcctttcaagggtaattgaggctgaatgaatgatcccgaatctgtaaaagctgctttgatgatagagctcagtagaccagaagtttgatttcattttgtatgtattatgctttgtatccgaaagggtctaagtggattaatattaaaactatgtatattaatcattggagaagggggaagaggaaatgaaaatagcacaaaaattaaaattggaacgaagtaagataattaaaacaaaaaacttatagatgttaggaaacctgctgtaattaaacataaaatgtcattcagggtttcctgactgctaatgcagaaaggaaaatcgtaaaggaaacagaaagatgaaataagccattgtgccctccgcctcagaaatgacaaaagactcttcactgagccctgtggcttcatggcagcagatcagagctgtgacattttctacatctagacatgctaccagacatggggaaccattagaggtgcaatctacattgggcatctggtcattcaatctgtttttttaaatgttatttttgcctttcaatgtaatcaattggattaacaatgctgcaatataatttagctataatcgtagtttaaattttttgatatccatgtaggggtatttcccatatttttggaagtagcggtcattagcaaagtaactaaataaaatacagtgctggtagtcaaaattaa

SEQ ID NO: 1030 - DNA, 4068 bp, Homo sapiens
cactggcggagaaaatccccttcttttttttctctctctttttttctttttgagacggaatctcactctttcacccagactggagggcagcggcgagatctcggctcactgcaacctccacctcccaggttcaagcaattctcctgcctcagccttccgagtagctgggattacaggtgcccgccaccacgcccagctaatttttgtatttttagtagagacaggattttaccatgttggccatgctggtctcaaactcctgacctcgtgtgatccccctgcttcagcctctcaaactgctgggattataggcatgagccactgcgcctggccaacaatccccttctaaaggcaggtggtgtctccagcaccagggccatacggctgcaacacccctacaagtgccgggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagacgaagctggctactacttcttcaacggcaactacaaggtggacagccccaagaacttcaacatcgcaggcacggtggtcaagtacaggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcgtcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggca

SEQ ID NO: 1031 - DNA, 3725 bp, Homo sapiens
cgccgtctgccctccgcagcgctcgcccctttctctgggaggacaacctgctgacccgaagccagggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagacgaagctggctactacttcttcaacggcaactacaaggtggacagccccaagaacttcaacatcgcaggcacggtggtcaagtacaggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcgtcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggc

SEQ ID NO: 1032 - DNA, 4270 bp, Homo sapiens
acgggacacctcatacatcccagaccccattctcaggagccccagggacagggcccgctctggaggcagaagccggacaggcggggctggggctttgccaccgccagcctccccggtaacctcaggccagcggctgctccgtctggacacccgacatgtggcccccagttctggacccgggaagaaggcctccctgctcgccgctcctgggccgccgccgccggcagcagccaacaggcagctgggccggcctggccgggctccagaggcgcagagcgggttaaagtgtgcgccaggccggccggcgcgggcgggggagcggcctggtgggaagtgtgagtgttcctccccgtctgcctgacagctataaaggcggccgccggcgcagagccgccactgggctgcgcccctcccgggaaccccctctcttggatgctctttgaagtgggagagggaggcggcgcgggggaggaggggaaggggagagggaggccgggccgcagcctctgcactcacgccgcccccgcacgcacagcgcacctggcgccgtctgccctccgcagcgctcgcccctttctctgggaggacaacctgctgacccgaagccagggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagacgaagctggctactacttcttcaacggcaactacaaggtggacagccccaagaacttcaacatcgcaggcacggtggtcaagtacaggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcgtcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggca

SEQ ID NO: 1033 - DNA, 7336 bp, Homo sapiens
cccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagagactgcacagacacaactcactactgtatgtttgtaaaacatcttaatttgtgttctctagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattgggaatggatgggggacagtgaggaggacacaccagcccattagttgttaatcatcaatcacatctgattgttgaaggttattaaattaaaagaaagatcatttgtaacatactctttgtatatatttattatatgaaaggtgcaatattttattttgtacagtatgtaataaagacatgggacatatatttttcttattaacaaaatttcatattaaattgcttcactttgtatttaaagttaaaagttactatttttcatttgctattgtactttcattgttgtcattcaattgacattcctgtgtactgtattttactactgtttttataacatgagagttaatgtttctgtttcatgatccttatgtaattcagaaataaatttactttgattattcagtggcatccttataaa

SEQ ID NO: 1034 - DNA, 4197 bp, Homo sapiens
ccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatg

SEQ ID NO: 1035 - DNA, 4167 bp, Homo sapiens
gaggatcctaaagggatggaccagtttcaccccctcctccatattctctgagctgtcctcccagccccaagctctctggacactggagaggtaaccaccaggcttctgtccctgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatgagaaa

SEQ ID NO: 1036 - DNA, 3906 bp, Homo sapiens
gtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagcccctctgcttcccctgcgccatgccttctttcttctccctggggctgggtcaggagacagcacaggtgtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgacccct

SEQ ID NO: 1037 - DNA, 2908 bp, Homo sapiens
aggggccccagtggccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaaggtgagcccggaacccccagccatatcctgcatcctgggtaaccacgcccaggacacctcagcctttccagcatagctcaataaacttgtattgatcaag

SEQ ID NO: 1038 - DNA, 4195 bp, Homo sapiens
ccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctggggcggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatg

SEQ ID NO: 1039 - DNA, 6058 bp, Homo sapiens
gctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcagataagtttctttaagatgggttctgaaaatcttaatgaacaactggaagaatttttagctaatattggaacaagcgttcagaatgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaataaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaaatcttcaattttgcaagcagagagtaaaaaagatcatgaagagtggatctgtacaataaacaacatatctaaacaaatatacttaagtgaaaatccagaggaaactgctgcacgagtaaatcaatcagctctggaagctgtcactccttccccatctttccagcagaggcacgagagcctgcggccagcagcaggacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacgtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaagatatgtgattctgttggactggcaaaacagatagctttgcatgctgaactggatcgtagggcatcagaaaaacaaaaagaaatagagagagtaaaagagaagcaacagaaagaactcaataaacaaaaacagattgaaaaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcagctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgtacagtgttttttaatg

SEQ ID NO: 1040 - DNA, 3239 bp, Homo sapiens
tttccctgccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaaatattctgtttctttc

SEQ ID NO: 1041 - DNA, 2190 bp, Homo sapiens
agtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgatgtctgtttatttttagagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgac

SEQ ID NO: 1042 - DNA, 3903 bp, Homo sapiens
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtgggctccatctccatggacctgcagctgaccaacaaggccttgcaggtcatgaccgactttgccatccagttcaaccgcaacagctttggcctggcccccgccacccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggc

SEQ ID NO: 1043 - DNA, 4155 bp, Homo sapiens
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccacccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatc

SEQ ID NO: 1044 - DNA, 4176 bp, Homo sapiens
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccacccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatc

SEQ ID NO: 1045 - DNA, 2935 bp, Homo sapiens
tgcagaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccacccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcagg

SEQ ID NO: 1046 - DNA, 3838 bp, Homo sapiens
tgcagaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccacccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggc

SEQ ID NO: 1047 - DNA, 2838 bp, Homo sapiens
tacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccacccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactga

SEQ ID NO: 1048 - DNA, 1908 bp, Homo sapiens
cacccatctgtcaccagcaggttgcgtcctgggaatttagggccctctgatgttgtattgggcctgcaggggaggggacaggctctgacggctttttcttctggagaggcaagaaattccgagcagctctcacattagttatctaagaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctccc

SEQ ID NO: 1049 - DNA, 4146 bp, Homo sapiens
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccacccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatc

SEQ ID NO: 1050 - DNA, 6841 bp, Homo sapiens
gctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgatttaaaa

SEQ ID NO: 1051 - DNA, 4792 bp, Homo sapiens
tagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagaatgaaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtctt

SEQ ID NO: 1052 - DNA, 4792 bp, Homo sapiens
tagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaaggaaagcaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtctt

SEQ ID NO: 1053 - DNA, 2966 bp, Homo sapiens
gtcgctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaaggaaagcaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctccaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatga

SEQ ID NO: 1054 - DNA, 4513 bp, Homo sapiens
agcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgctcctggccctgcggacgtcagcgtctaataattctcccggtcttcctgattgcctgaaagagtcgggacggttcggttgattgtgtttcccggttaggactcggtgtaggagatccatcgaaccactcgctcagggtaatgtttatgaagcagattatgtttatgaagcagattaaatggcttttgggaggcaagagctgtcaaatgttttctcatatgtggattccctccctgtgctgaatacttagctttttggtgcttactgacacttgtgtggtatttttttttctcccctattatatatccctgagcacggaaatctgtccatggagaaaaatattaatctgaggaactgtcaaacactgaacacctatgtaatgctcactcatttaaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaag

SEQ ID NO: 1055 - DNA, 1166 bp, Homo sapiens
atgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggaaatgatttataaacaaacaaatgttactggatatatcctaggtggcataccaaattcctaagttatctgattctaaacagtattacagcaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttg

SEQ ID NO: 1056 - DNA, 1774 bp, Homo sapiens
gttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagc

SEQ ID NO: 1057 - DNA, 2355 bp, Homo sapiens
attcctgacagcacctcccggaccggacataacggtccccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccggcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 1058 - DNA, 1578 bp, Homo sapiens
ggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaagggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgca

SEQ ID NO: 1059 - DNA, 2391 bp, Homo sapiens
attcctgacagcacctcccggaccggacataacggtccccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttgggtaaatacccaggagtgggatggctgggtcacacggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccggcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 1060 - DNA, 1705 bp, Homo sapiens
attcctgacagcacctcccggaccggacataacggtccccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctg

SEQ ID NO: 1061 - DNA, 1751 bp, Homo sapiens
aggcgcttccgcaggaagaaggaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtcctcctcgcgagtgccttcttgcaattacctgccttagcgggtgttgcgggtccctccttcacagccgctgagcccagaggtcccgctggcccctcctctgaattttaggatgtcattaaaaagatgaatct

SEQ ID NO: 1062 - DNA, 1306 bp, Homo sapiens
ggcgggacggggcggggcttcgggcgagagggagggcagcaggagaaaggataagaaagggagtgggactggcgcctacggtggccgaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcaccccagatgtccttccctccctaataactgtaaatatataaatatgtcaggttaaagggaaaaggtgttcagggcacttcttgtcctctctgtcccataacctacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaagtaaaagcatttctggac

SEQ ID NO: 1063 - DNA, 741 bp, Homo sapiens
gaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggaatttcatttcctgtattttatctggccaccctaccttaaacggatttttatgcccaatgcgtctccaaacgggctgcccccaactccctgagctgcctttatgga

SEQ ID NO: 1064 - DNA, 2237 bp, Homo sapiens
gcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacataccttttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 1065 - DNA, 600 bp, Homo sapiens
cctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagagccagaatgaagaatggggaggtttgtctgaggatatcttatga

SEQ ID NO: 1066 - DNA, 3492 bp, Homo sapiens
gggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgta

SEQ ID NO: 1067 - DNA, 1496 bp, Homo sapiens
atgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgta

SEQ ID NO: 1068 - DNA, 530 bp, Homo sapiens
gtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagccacgtcatgaatattttaatgtccctgtgtactaaatgactactcatcgagtatgcagaatttcacagaggaaatagaatgctgatatacatatgaaagaaaatatcctcagcatggtgatttat

SEQ ID NO: 1069 - DNA, 991 bp, Homo sapiens
gttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagagccagaatgaagaatggggaggtttgtctgaggatatcttatgataaagagcagtctaaggctttagtccctttgatccccaacttatttattggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaa

SEQ ID NO: 1070 - DNA, 919 bp, Homo sapiens
atgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttat

SEQ ID NO: 1071 - DNA, 315 bp, Homo sapiens
atgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtga

SEQ ID NO: 1072 - DNA, 3433 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 1073 - DNA, 3499 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 1074 - DNA, 1980 bp, Homo sapiens
tcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggagggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgc

SEQ ID NO: 1075 - DNA, 3256 bp, Homo sapiens
ctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaatctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaatt

SEQ ID NO: 1076 - DNA, 1498 bp, Homo sapiens
gctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattag

SEQ ID NO: 1077 - DNA, 2109 bp, Homo sapiens
ctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgctctgcttg

SEQ ID NO: 1078 - DNA, 4575 bp, Homo sapiens
ctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggagggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcatggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgc

SEQ ID NO: 1079 - DNA, 2184 bp, Homo sapiens
actccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatc

SEQ ID NO: 1080 - DNA, 2175 bp, Homo sapiens
actccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatc

SEQ ID NO: 1081 - DNA, 5719 bp, Homo sapiens
gtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatg

SEQ ID NO: 1082 - DNA, 5761 bp, Homo sapiens
gtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatg

SEQ ID NO: 1083 - DNA, 3415 bp, Homo sapiens
gaccggcggaggcgaggaaatcctaagagcgtgaccgttgatgatgcagggaaccgtcgggtgtgaccattgagagggaaaaggttggagaaagggtctctaccatgatgcctgtggtgcggtgagggaatcctcgggtgtggcagcaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactg

SEQ ID NO: 1084 - DNA, 3425 bp, Homo sapiens
agtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagcacataaagcacatttggtttttaaattgctgtcctgtgaccatctatctaaggagttggcaaacgtttttgtaaaggacaaaatattctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactg

SEQ ID NO: 1085 - DNA, 2621 bp, Homo sapiens
attttaagttttcattgaagagtgagagaaactcggcttacggaccaggaaaactgagagtgctgcctggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttg

SEQ ID NO: 1086 - DNA, 1931 bp, Homo sapiens
actgcggtgaaagccgaggcagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 1087 - DNA, 2091 bp, Homo sapiens
cttcctgaggcgggggcggtttctcgaaggcagtcggtagttgtagttttgctaaacctagagcgcttcaaattgcaagcaaggaggccgcgaggcctgacgggatttgtagtcggcgctagacgccggcgcgcacgcgcagccggggccggggcggggcggcggcactgcggtgaaagccgaggcagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 1088 - DNA, 1950 bp, Homo sapiens
ggaataaacaggaactggagcctggctgaggggaggggcatgtctgggagggctgcagggtcacttactaaagggttgagtcaggaaagaagctccagtgacctgcacagctccacaggggatgttggcagcgattctgaggtcttcttttaccctgcccccgcctgtcctaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtg

SEQ ID NO: 1089 - DNA, 545 bp, Homo sapiens
gaggacaccaggtgagccggggatctggccttatggcgtggaggaggacgctgcgggtcgtctgcctcgccgcgcagctttgtcctgccctgcactgagctggcggaaagctgcccacacccgggagtggcttcagccttcggacccgggagctagctgacggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatg

SEQ ID NO: 1090 - DNA, 1720 bp, Homo sapiens
agcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggt

SEQ ID NO: 1091 - DNA, 1750 bp, Homo sapiens
actgcggtgaaagccgaggcagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgg

SEQ ID NO: 1092 - DNA, 890 bp, Homo sapiens
atcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 1093 - DNA, 776 bp, Homo sapiens
atcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 1094 - DNA, 5838 bp, Homo sapiens
actgcgcatgcgcagggggtggactgccaggtcggctcagggagccgtgacgagtccggaagcgcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaatagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgtaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcatatttgtctttgcatttttaatgagaaactattaataatcctgaagttcatatgctaaagttttcttattttaaagcaagtattttgagtgttacattatgcagagaagcaatgtggtttagttagcgaaagaaaaaccacttccaaaccaagtaaattttctacttatagtttactccaaggaaaaaaaattggtgtatttaataacaaaaacaaaaatcttcatattgcaaaataaacatcttctaggtagttttgatctattagtagatatctgattatgtggcctgctgaataaattctttgaatctcatttttccttatgcccaactttggaaactaactagcataaacttatagaaatgtttaaaactagttatatgatcaacctattagcatcttttcctagagtatttgttttatttgctaccttaagttactgttttcaaggttgttctataatcagagaacttttctaatactttcgtacctttttaaaaccagctgaaattttacttcctttttgaagcaaggtaatggactttcaggtagtataagctactcagttctttttgtatagagccacatacataatgatttttaaaaagtaaaaaggaagtgactgtacattgcttgaagcattataggaaggctgaaaagaaaagaatggaattttcttggaacatacatattgaaaagaacaaaacagagtcgaaaaattatttaaattttcaagctggtgggatgacaagagtaaacaaaattgttaaattttcctgctccagaaagaaatatagccctgaatctccgggaagagaatgtacagaagtgcaatgtacagaagccacgtgtacattttgtgccaattccgtaccatgtgtacattctgtaccattctgtaccaatgtatggaagccacgagttccacttccctctggagcctgggcgctgtggtaacacacccaaaagcccctttgtaatcgcaggtcgttggcatttccatattagccttattgctcagagcttcataactttgaattttaagtcaataactttttgaaatgtcagacagaatttgacaggtttaatacctgttttctgaggaagaaaaaaaaattatatccatgctgtcttcaggcagagggaaagtgcatgttgtgattgagaaaggtcttatttttccttaaattaggacactcatctttaaaagatagttcacacatttgtatttttttaaactaaggaaatttaattagggctttacttttgactaagttatttttggctgctaacttttaaaattatggtaaatcaataatataatgtagtatgaatcagtgaacagtatgtatcgattgtaatgtgcgctaccagttgaaaccattttaacactagtagcttaatatcattaaaatgtttttcacgtaaaacagaaaaacgaccaaagccccaagttaaaggtttggttttttttcttttgtggtgtggtgattcagagttccttgcctcatatttcctttaactttgtcataatccatgattatctttaaattgttccattgagtcgagttagtcaatgttgaattcttaattctagctatattttttcattttaatgttcacttaatgggacattttatgtacaccaatcttgaagaatggctctcatagtatatttcagactaagcctcatttttgatatcacaatacatttgctttatttattatgagagtttttttattctaaagagactgtaacaatgcatttctcaaattaaaatactgtatacttgtccttctcga

SEQ ID NO: 1095 - DNA, 1822 bp, Homo sapiens
acgagtccggaagcgcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaatagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgtaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggtagttttaagtgaa

SEQ ID NO: 1096 - DNA, 2527 bp, Homo sapiens
acgagtccggaagcgcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaatagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgtaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggaa

SEQ ID NO: 1097 - DNA, 1730 bp, Homo sapiens
atccgtaagtccttcccctccagcagcaattgaagtaggaagctgcaacacagactgcggctcctccgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaa

SEQ ID NO: 1098 - DNA, 1122 bp, Homo sapiens
gccccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatgtatcctttttcaatactgttttccacagtacttggcaaatgcactctggtccttatcagacaaggtcttgctctgtcacccaggctggagtgcagaggtgcgatcatggctcactacaccctggatctcctgggctcaagtgatcctcctacctcagcctcccaagtagctgggactacaggaaccaattgatgaacttcccaaaatatgctcagccctggagccccagcagacttgcttttctccagacagttcatcattcaaaggagctgcctccaccacccccatctactgaatagccaggggagggcaccaatgaacagcacagtatgggagacacaccaactactcttcaaatcagtgcgtacctgctctacgcgtgaaggtacagaaaacctccacggccttttcagtatttggtgcctttaaagaggcctaaggacttagtttatttgggctagactggaatgcagcagtactgccttcaggcctggacagccaggggctcctcgggccctgtgctctagaaggcccattctatgtctgcttcgccagcaccctttccccatcatggggcagatgcccaccagccctcactatctactgcttgaccatcctctgact

SEQ ID NO: 1099 - DNA, 1491 bp, Homo sapiens
gcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtggaaccaattgatgaacttcccaaaatatgctcagccctggagccccagcagacttgcttttctccagacagttcatcattcaaaggagctgcctccaccacccccatctactgaatagccaggggagggcaccaatgaacagcacagtatgggagacacaccaactactcttcaaatcagtgcgtacctgctctacgcgtgaaggtacagaaaacctccacggccttttcagtatttggtgcctttaaagaggcctaaggacttagtttatttgggctagactggaatgcagcagtactgccttcaggcctggacagccaggggctcctcgggccctgtgctctagaaggcccattctatgtctgcttcgccagcaccctttccccatcatggggcagatgcccaccagccctcactatctactgcttgaccatcctctgacttcctgggcccctagaatttataaggtccctagatatcccagaacctgccaccatggcctctgcaagcctctcctccaccttcaccccaagactaggggcaggaatgataagaaggctgggtggtagctgggatgtcccacctacgtgcctggggagagaagcaagagcaggctggagtctctactttgtattcttgtgaggcacaaatataggctagaatccaggccccacaaatataggctagaatccggaatgttttcttgatttaaagacatctttagaccgggcacagtggctcacgccagtaatcccagcactttggagggctgaagcaggaggattgcttgaggccaggagtttgagaccagcctgggcaacatagggagacccagtctctacaaaaaaatttaaaaagccaggcattggtggtgtgtgcctatagtcccaactactagggaggctgaggtgggaggatcacttgagcctgggggactgaggctgcagtgagccatgattgtgctactgcactccaatctggcaacagagcgagaccttgtctttaaaaataaaaataaaaa

SEQ ID NO: 1100 - DNA, 2742 bp, Homo sapiens
ggggaattaaggctggaactggagagggaggggtctgcggtcagtcggacgcggcgctggaaatccggcggaggacctagaagtagcgggagcgatctgtgggcggggcgaacggcctgccggccgacggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaa

SEQ ID NO: 1101 - DNA, 1225 bp, Homo sapiens
ggagtcgggactacgcttagcgctcgctcgcggggagaccggcagcggtcttctgtttggtctcttgacaagggggcgggacttccgcagaaagcaagattgggcctatccgcgatgagaacggcgtggagggggaattaaggctggaactggagagggaggggtctgcggtcagtcggacgcggcgctggaaatccggcggaggacctagaagtagcgggagcgatctgtgggcggggcgaacggcctgccggccgacggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccatag

SEQ ID NO: 1102 - DNA, 1476 bp, Homo sapiens
ctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtaggtgtctgctccttttccttcttgagaacctagaccagccagcaagaaaactgtggttagaggaaccatagagagcaaagggcatgaatcttgcttcagaagcaaagtactatgcactaaataattgggtcagtgactacaaacacgggggaagagagtttttttttgttttttgtttttttttggtcaagattggtgttgctgtatcttccaggatggagaatacaggtaacacaaactacaatacttaaaattgttgttgtcttctatccaaaatgctttcctatacatcatcttaccacagtatcgtgagacagtcaggaaaagtagacaaatgtcattaacttcattttaaagatgaagaaactcaggcacaaaaacagttatcaaattgccaaaagggcacatagttttagaaatgggactgaaatccagctttcctgactcaaagtcctatgttaatccaccagtcatttattgagcttctgctat

SEQ ID NO: 1103 - DNA, 2144 bp, Homo sapiens
ttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaa

SEQ ID NO: 1104 - DNA, 2818 bp, Homo sapiens
ggacctagaagtagcgggagcgatctgtgggcggggcgaacggcctgccggccgacggtagggcctgaagagcctagggtggggctcgcggtgtcgcggagggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaa

SEQ ID NO: 1105 - DNA, 980 bp, Homo sapiens
tctgcggtcagtcggacgcggcgctggaaatccggcggaggacctagaagtagcgggagcgatctgtgggcggggcgaacggcctgccggccgacggtagggcctgaagagcctagggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttgg

SEQ ID NO: 1106 - DNA, 681 bp, Homo sapiens
gcggcgctggaaatccggcggaggacctagaagtagcgggagcgatctgtgggcggggcgaacggcctgccggccgacggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgaga

SEQ ID NO: 1107 - DNA, 6758 bp, Homo sapiens
aaaaacaggaagtgcctacggaggccgggccggcagcggcggccgggcatgaagccgggcggctacgggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgaaaatgatgaaggaatgtatggtgagacttatatattgtgaaatgcttggatatgatgcttcctttggctatattcatgcaatcaagttagcccaacaaggaaacctcttagaaaaaagagtaggttatttggctgtttccttatttctacatgaaagtcatgaattattgcttctccttgtgaatacagttgtaaaggatctgcagagcactaacctagtagaagtgtgtatggcactgactgttgttagccagattttcccctgcgaaatgattccagctgttcttccattaatagaagataaacttcaacattctaaggagattgtacgaagaaaagctgttctggcattatacaaattccatctcattgctcctaatcaagtacaacatattcatattaagtttcggaaagcactttgtgacagagatgttggggtcatggctgcctccttgcatatatatcttagaatgattaaggagaattcatctggatataaagacttgactgggagttttgtaaccattttgaagcaagtagttggaggaaagctcccagtagaattcaattaccacagtgtgccagcaccatggttacaaattcagctcttgagaatactgggacttctaggaaaagatgatcaaaggacaagtgaattaatgtatgatgttcttgatgaatccttacgaagagctgagttaaatcacaatgtcacatatgctattttgtttgaatgtgtgcatacagtctattctatttatcctaaatcggaattacttgagaaggctgccaagtgcattggaaaatttgttctgtcacctaaaataaatctaaaatatttaggactgaaggctcttacctatgttatccaacaggatcctactctggctcttcaacaccagatgacaataattgaatgtttagatcatcctgatcccattattaaaagagagactctggaacttctttacagaattactaatgcacagaatataacagttattgtccagaaaatgcttgaatatttacatcagagcaaagaagagtatgtcatcgtcaatttggtcggcaaaatagcagagctggctgagaaatatgctcctgataatgcatggtttattcagacaatgaatgctgtgttttcagtaggaggagatgtaatgcatcctgatattcccaataactttctgagactactagcggaaggttttgatgatgaaacagaagatcagcaattaagactctatgcagttcagtcttatctcactttactggatatggaaaatgtgttctatccacagagatttcttcaagttatgagttgggtattaggggaatattcctacctcttagataaggaaacgccagaggaagttatagctaagctctacaagttacttatgaatgactctgtgtcttcagaaacaaaagcctggttaattgctgctgtgaccaaattgacatctcaggcgcactcttctaatacagttgagagattaatccatgaatttaccatatctttggatacttgtatgagacaacatgcatttgaattaaaacatttgcatgagaatgtggaacttatgaagagcttgcttccagttgacaggagttgtgaagacttggtggtagatgcttctttatcttttctggatggttttgtggctgaaggactcagtcagggtgcagcgccttacaaacctccccatcaacgccaggaggaaaagctttctcaggaaaaagttctcaattttgaaccatatggactctccttttcttcatctggcttcactggacgacagtctcctgctggcatttctcttggttcagatgtatctgggaatagtgctgagacaggactgaaagagacaaatagcttgaagctggaaggtataaagaaattgtgggggaaagaaggctatcttcccaagaaggaaagcaaaactggtgatgaaagtggagctctgcctgttcctcaagagagtataatggagaatgtagatcaagctataactaaaaaggatcaatctcaagttcttacccaatctaaagaggagaaagaaaagcagctgctggcatcatcattatttgttggtctaggatcagaaagtacaatcaacctgctgggaaaagcagatactgtctctcacaagttcagaaggaaatcaaaagtcaaagaagctaaaagtggcgaaacaaccagtactcataatatgacctgttcttcctttagttctttgtcaaatgtggcatatgaagatgattattattcgaatactttgcacgatacaggagacaaggaattaaagaaattttctctcacttcagaacttttggattctgagtcactcacagaactgcccttggttgagaaattctcatattgtagtctgtctacaccttcattgtttgctaataacaacatggaaatttttcaccctcctcaatctactgcagcctcagttgccaaggaaagctctttagcttcatcttttttggaagaaactactgaatacatacactcaaatgctatggaagtctgtaataatgaaactatatcagtgtcttcttataaaatttggaaagatgattgtttattgatggtctggtcagtcactaataagagtggtttggaattgaaaagtgctgacttagaaatttttcctgcagaaaatttcaaggtgactgagcaacctggatgctgtttgcctgtaatggaagcagaaagcaccaaaagctttcaatatagtgtgcagatagaaaaaccttttacagaaggaaatcttactggttttattagttatcatatgatggatactcattctgctcagctggaattttctgtaaacttatcactattagatttcattagaccattaaaaatctcaagtgacgactttgggaaactctggttatccttcgcaaatgatgtgaaacaaaatgtaaaaatgtcagaatctcaagctgcacttccttctgcactaaagactctgcaacagaaactaagactccatattattgagattataggcaatgaagggctattggcctgtcagctgctcccatccatcccctgcttactgcattgccgagttcatgcagatgtattagccctgtggttcagatcctcctgttctactcttcctgactatttactgtatcagtgtcaaaaggtgatggagggatcctagcagaagccctgctaaattttactccatcaagatcaatggtttacatagataaacttatttaccaaagtaaaaagaactcatggtacttctaatgaaaatggggattattacaagtgtggtttatatgttttctttgtgattcctggtcaagaaagatccccaaaactgtatccctaacctttaactcaggattgtacagtatgtttaggtccctcaaaaagtgacctaagctaatgttataaactgctaatgatttatatatcacttagtgtgtagagggactgaaaatatttattttgttataaataattttatagcacgtttactctagtgctagctaatttgtaataaagccaagtctcagttttctgcattaaatggaagggagacatgaaattgataatctcaaacttaattcatatttggctttggaatgtagtgtatggtttttggtagggaagtcaatattttcgattatgttttgcttagatcagtgttgaactaagttggcatagcacacactaacagttgtaggagatccatgagcatgctggatattgaggggatccaatctgtgatctattttttattatagataactgttacacataatttcagatcgtttggctgtaaaatttgtctgttttccacttggagttattttaaaattcaaagtaaatcactctattcttattttgaaaactcagagccattttatatagaaacaaaacccataagagcacacagtaacaaagcaaacagatacaaaaatgactttttagttatgacaaatattttagttggttactacttaggtccttttggcaaatgaaaatttgtgattagagtataaatggcaaaactatcttttcctggcctttgaatccactagtacttaatggatatagctgaagcagagactaagtataacatacaggttcttcagtaaaatatatcattttcatgttatagttatgcctgtgtggcctctgtcagaactattatcagtaaaagaggttaagcctatatatgaatgatggaccaaaaccttgaggttgtacattaactgaaatagtattttataaaatcttatggtgctgtggaaaatatttattatttcaccttttctgacacttcaccatggagactattcaggtaatacaattttaagtcattgcagttaatactctggttaattggtactgttaatcacccaggtcaggaattctgattttaggttatctcattaatcatggctgataaagaagctaaggggattctccagatctaatagatttcattagtcatttgtgtcgagtattcctccctaaaaacaaaagcagtattttctttctcaattaatttttaagttattcattaaaaaatatataacatcttaattttattcttttaaaaacatacagtgaagccttgctacaagagtcataagtgactggaatttcttgcataataggttcctccttttgaatagatcagattcatccccaggctctcagcagtgtcatgatgaaatgagtgtgctgacttcaggggtgtggtggacactggtagctagccttatcagctccctccttattcctacctctgtcagcagcatgcctcgccccttacctaattctgctgtgactctgacagagaggaagtgccttctcactttgcaaaggaatgcagcatgtcacaaaggaggtgctccaattttttgtgtccttacttccctatgtttgcctagttactgaggctaggtcgagtgtgaagcaataggtgtaagatgctgagagcacatggacagctaccagggagatctgttgcttggttacagggtgtattcatgagtggtagctgcagttgtcgtgagagacatgcttggcatacagagctgtctaatgggtgggagacatgtaatggtagatttagggctgggagcatgattttgggtctgcccaaaggaacatggtgtcacttttgttctttctgacccactaaataaaaagtagtgtaacagggtttcactggaatgtttattagaaagtttacactttttatatttttatgattttaaaaacaaacaataatagaaaaacagattttaaggaacttcagagcagtatatattctgtctaaactcactgaatattttaagttgtaaatcaggtgtccaccaacctttatttttgcattgcaggagatgtgactgtaaagtagggagtttttttttttgagacagagtttcacccttgttgcccaggctagagtgtaatggtgcaatctccgctcactgcaacctctgcctcccaggttcaagcgattctcctgcctcagcctccctagtagctgggattacaggcatgcaccaccacacccggctaatttttttatatttttagtagagacaaggtttctccatgttggtcaggctggtctcgaactcccgacctcaggtgatctgcccgcctcagcctcccaaagtgctgggattacaggcgtgagccactgcgcccggccaaattatttttgtgggtagattcattctctttacctaatagtcataatttagtcagtgaagggacaacatctggggtaagagctatggaggaggtgctcagctttgtgagttttgtgccaggcatctttgctgaaaatggagatggcagcaagtgtgaatctgggggaatataagggaagacagaaaagccttaagagtagacggaggaagaagggtaccagaatagtccctgtggaggcaggcagatcagagctcagggtttgaaagtgggcctgagtaagggtcctgctagagaaactgcagatggaagctgagcagttaccaactgctaatgtgccaagtataccaagcacagcatgtgtcctgtagaggagcattattttaaacaatgttctactatcatctaccaaaataattgtggtaaaagtgtagtattttattttttccttttatgtcagcaatattttaaaatattgatctgtttatcttatatttttatggataaatgtagtatttgcctcatgattgtgagccactgagagtgcactgaacctattcacatgtctttaagatgttttgctgtgttaaaattttaggagagaaaaatacaagtgaataattatttaataggcatttattactttattttggagttgaattctgtcatttgaaaaagttcagtaatgtaataaatacaaagtgatctgcactgtt

SEQ ID NO: 1108 - DNA, 1817 bp, Homo sapiens
ggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 1109 - DNA, 1572 bp, Homo sapiens
gcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaagaggcctaacatcgtgtcccagctcagccaagcctgcgatggagccataacgagtcgtccagggcgtcttctcgtccacccagctctgtaaggggaaggaaataaactaagatgaaggggtctgaaagga

SEQ ID NO: 1110 - DNA, 2256 bp, Homo sapiens
taaaagccaaaatggctgccccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatgtatcctttttcaatactgttttccacagtacttggcaaatgcactctggtccttatcaggaaccaattgatgaacttcccaaaatatgctcagccctggagccccagcagacttgcttttctccagacagttcatcattcaaaggagctgcctccaccacccccatctactgaatagccaggggagggcaccaatgaacagcacagtatgggagacacaccaactactcttcaaatcagtgcgtacctgctctacgcgtgaaggtacagaaaacctccacggccttttcagtatttggtgcctttaaagaggcctaaggacttagtttatttgggctagactggaatgcagcagtactgccttcaggcctggacagccaggggctcctcgggccctgtgctctagaaggcccattctatgtctgcttcgccagcaccctttccccatcatggggcagatgcccaccagccctcactatctactgcttgaccatcctctgacttcctgggcccctagaatttataaggtccctagatatcccagaacctgccaccatggcctctgcaagcctctcctccaccttcaccccaagactaggggcaggaatgataagaaggctgggtggtagctgggatgtcccacctacgtgcctggggagagaagcaagagcaggctggagtctctactttgtattcttgtgaggcacaaatataggctagaatccaggccccacaaatataggctagaatccggaatgttttcttgatttaaagacatctttagaccgggcacagtggctcacgccagtaatcccagcactttggagggctgaagcaggaggattgcttgaggccaggagtttgagaccagcctgggcaacatagggagacccagtctctacaaaaaaatttaaaaagccaggcattggtggtgtgtgcctatagtcccaactactagggaggctgaggtgggaggatcacttgagcctgggggactgaggctgcagtgagccatgattgtgctactgcactccaatctggcaacagagcgagaccttgtctttaaaaataaaaataaaaacatctttacaacattcctgtttgtattttataaactcaaaatctcaaagactgagcagttgattctagagccctaaagctctggtgggttgtgtgaaaaaaccctgattcatgtcccttctattgcagttgagggtgggacataggaagggcatcaatgctgtgtgcactctctgtgactccgccagcatctgccatggtgcttcctggagaatgatggtgtgcaggcaacagtgatcagcaccaccatggtttgcagacaggcctcgatcaggcccactgtgggcatctacctctagttccatcagcttcctaaaatctgaaatacttttagagatccggaaaccagaatagggtttctccaagtgggagataatgtcagcctgatttaatgagaaattgcaaaaatacttgttcaaactgaggctataggaataccagccagaagaacaaacaaattcttcagggaagcatccagcactgaagtggcagcttctaaatgaactgaaattttctgcatgttctctcagaaagttacagtgttaattaattaataaaatcattacaaaagaatttcttccgaggtatgatggagcatgtgatgacttcaggaatggcttgatttgtttgtttgtttgtttgtttgttttttgagacagtct

SEQ ID NO: 1111 - DNA, 817 bp, Homo sapiens
gtaagatgcctatcctagtccctctcttcgggctcttcatctcaagaggaacaaacaagagcaaactcagtgttgagaggccccaaaccggactctcccacagagaggtgctcggtcccaagccccggaggcccgggaaggccgcctccggaggagcccccgcagacgccatactaaaagccaaaatggctgccccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtggtaaaagggcatataatgtttaatttggataaagtacacatcattttggatgagatggtgttaaatggctgcattgtggaaactaacagggcaagaattcttgcccctctactaattcttgataagatgtcagaaagctga

SEQ ID NO: 1112 - DNA, 1405 bp, Homo sapiens
ggaaaaggggggtaagatgcctatcctagtccctctcttcgggctcttcatctcaagaggaacaaacaagagcaaactcagtgttgagaggccccaaaccggactctcccacagagaggtgctcggtcccaagccccggaggcccgggaaggccgcctccggaggagcccccgcagacgccatactaaaagccaaaatggctgccccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaaggcattttgagtaacgctgttttctgaaagctatttttttttttttgagacggagtctagtctagctgtgtcacctggcacattctcggctcactgcaacctccacttccggggttcaagcgattctcctgcctcagcctccgagctgggactacaggcatgcaccaccacacctggcta

SEQ ID NO: 1113 - DNA, 769 bp, Homo sapiens
gccgcagctaccggacacctgggctccgactctgacttttggaagcgaggcggccttaggcttcctggttatcagtttccttttagcaggccgtccccgggcgctgtttccttcccaggggtctctcacccgtgtcccggctttctgagctggttgttaacctggctggtcgctctggccgaccgcatcccgtctcggattcctgacgtttctttttcattctttgagtgtttcaggcagtcccaagggtgggccctctttcccttcctgtcactcgctctgcctctggtttcttagaaccagtcagttctctgctggcaaatagccaagatcctccggctgtggttactgattcctcgtctctgtcttgagcctgggctttggtcccatttctatgcgctcggtcgcccgtcgtaacttattccactttgcgtcccctcttctttccttttctggaatgggttgtgggggggttgggagagggggaggagcgattttttttttcttgggagaagaagaggtagtgaattcctttagatcttgacgatgatgggtagagggagagaagtttgaaggagactggctagactaacaatttgatacggtagaaatgaatgggctcacaaatattgtcatcaatagactattttgatcgaaacagaaaataaaagcactgttccagttacagccatcccttgtcataacttttgaactgtatttggaaaaatactggccaggaaagaaaaatgataaaatttttcctcatggt

SEQ ID NO: 1114 - DNA, 542 bp, Homo sapiens
atactaaaagccaaaatggctgccccgaggaggcccgcaccgcgtagccagtgaaggttggggagcaagcttatgcgggaaagagggagggggactccaggaaaagccgttgagaggaccatcacaacctgagcagcacagtgaagaaagaaagctgaagagctcttggtcacttcagttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtg

SEQ ID NO: 1115 - DNA, 663 bp, Homo sapiens
aaatctcttcagtcgtttcataaatacagcatcgatcgtctggtttggtttttttatagataaagaaacggatgggggaaaggagatctagtggagagtactgtaaaaagaaaaattcagtgctgaaagcgttgatgagtcactaagtaaggaataactacagagaatccaagtgagtaaggcagcatctcaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcc

SEQ ID NO: 1116 - DNA, 6591 bp, Homo sapiens
atgggggttgtgaattttgtgttcagagcgtcagaggacttgcaggtattagaaaactactcggatgctccaatgacaccaaaacagattctgcaggtcatagaggcagaaggactaaaggaaatgagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattctgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgc

SEQ ID NO: 1117 - DNA, 7038 bp, Homo sapiens
cacacccacggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgaggagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattctgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgc

SEQ ID NO: 1118 - DNA, 7031 bp, Homo sapiens
cggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattctgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 1119 - DNA, 4632 bp, Homo sapiens
aaattccggcggaggggcgagctggcaggccggctcctcccactctgggcagcggggtcccgcgtcccctcccccactatttggcagcgtctgggggtctggggcagcttcgttcattcacccgggggagttgggtttccgggaagggtcggaagctcctccctcgcttcctggtgggtaatggggtggtgcctttgactccgggggtggaaaagcgaccccacattcaaggacgccaatggcatgttgagctttcccaatctaaaccaggtattagaaaactactcggatgctccaatgacaccaaaacagattctgcaggtcatagaggcagaaggactaaaggaaatgagcagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattctgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataa

SEQ ID NO: 1120 - DNA, 5374 bp, Homo sapiens
cgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgaggagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattctgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagca

SEQ ID NO: 1121 - DNA, 284 bp, Homo sapiens
gtgggccgaggccgcgcgcctggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaaggtgtgagccactgcaccaggccccttcatcttaattttaatatatctttgaataaacaccattgtat

SEQ ID NO: 1122 - DNA, 1068 bp, Homo sapiens
cacacccacggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgaggagtgggacttcccctctcgcatgcctcaatgctatgctacattccaattcaagaggaggagaggggttgttttataaactgcctggccgaatcagccttttcacgctcaaggtgtgagccactgcaccaggccccttcatcttaattttaatatatctttgaataaacaccattgtatgaacctgctgtaagcttgggagtggtctgttagtctacagcttgtgtctgagatgtgctaattgaatatttgctcagtacctcatcttaactgcctttggctttatgttgcttatccttcatagtatcttgttcattggccttttacatccataggcatcacttctctgatattcgttgtgctcttttaatggattaatggtttgcttggttggttcctctagttagactgtaaactccttgagagcagagtctgtattttattaattacccacagtactaggtacatagttgccttcaataaatatatatttaatg

SEQ ID NO: 1123 - DNA, 983 bp, Homo sapiens
cacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacagg

SEQ ID NO: 1124 - DNA, 3781 bp, Homo sapiens
gtacagtaagaacccaatatggcagcggcggtagcagtggcaacggcagcaagaggaccggccgccccatagacccccccgcgcaccacccccgccgcttcctctgcttgggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtcttagaaaaataccccaatacacccatgagtcataaagaaattcttcaagttatccagagagaaggactaaaagaaatcagcagtgggacttctcctcttgcatgcctgaatgcaatgcttcacacaaactccagaggtgaagagggcatcttctataaggttccaggtagaatgggagtatatactttgaagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaagtatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaaggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaa

SEQ ID NO: 1125 - DNA, 8889 bp, Homo sapiens
gtacagtaagaacccaatatggcagcggcggtagcagtggcaacggcagcaagaggaccggccgccccatagacccccccgcgcaccacccccgccgcttcctctgcttgggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtcttagaaaaataccccaatacacccatgagtcataaagaaattcttcaagttatccagagagaaggactaaaagaaatcagcagtgggacttctcctcttgcatgcctgaatgcaatgcttcacacaaactccagaggtgaagagggcatcttctataaggttccaggtagaatgggagtatatactttgaagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaagtatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaaggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtg

SEQ ID NO: 1126 - DNA, 3299 bp, Homo sapiens
tcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaaggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttca

SEQ ID NO: 1127 - DNA, 8943 bp, Homo sapiens
acagtagtgacggccgcgcgggagcggtcacatgaccgtagcggcagcctgtacagtaagaacccaatatggcagcggcggtagcagtggcaacggcagcaagaggaccggccgccccatagacccccccgcgcaccacccccgccgcttcctctgcttgggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtcttagaaaaataccccaatacacccatgagtcataaagaaattcttcaagttatccagagagaaggactaaaagaaatcagaagtgggacttctcctcttgcatgcctgaatgcaatgcttcacacaaactccagaggtgaagagggcatcttctataaggttccaggtagaatgggagtatatactttgaagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaagtatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaaggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaa

SEQ ID NO: 1128 - DNA, 7620 bp, Homo sapiens
gagcaccccgtggaatcccccacgtcatcatcagaaccatcaatgagatgcaaacatgaaagacaagaggaagaagaaggaccgcacctgggccgaggctgcccgcctggcactagaaaaacaccccaactcaccaatgacagcaaagcagatattggaagtcattcagaaagaagggttaaaagaaacaagtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatggtaaacaagactgttcctcgtgttgttttgacaccattaaaggtgtctgatgagcagtcggattcgccttcaggatctgaatctaaaaatggtgaagcagacagttcagataaagaaatgaaacatgggcaaaaatctcccactggaaaacaaacaagtcagcacttaaaacgattaaaaaagtctggtttagggcacttgaaatggaccaaagctgaggacattgacatagaaaccccaggatctattcttgtcaacactaacttgagggcattaataaataaacatacgtttgcttccttacctcagcattttcaacaatacctcctgcttttgctcccagaagtggataggcagatgggaagtgatggaattttacgcctcagtacttcagctctaaataatgaattctttgcatatgcagcacaagggtggaaacagcgactggcagaaggagagtttaccccagaaatgcagttgcggataaggcaagaaattgagaaggaaaagaaaacagaaccttggaaagaaaaattctttgagaggttttatggagaaaagctgggcatgtcaagagaggaatctgtgaagctcactactggaccaaacaacgctggagctcaaagtagttcttcatgtgggacttctggccttccagtttctgcacagacagccttggcagaacaacagccaaaaagcatgaaaagcccagcttctccagagcctggtttctgtgctactctttgccctatggtagaaattccacctaaagatataatggcagaattggagtcagaggatatcttgatccctgaagaatctgtaattcaggaggaaattgcagaagaggtagagactagtatctgtgaatgccaggatgaaaatcataagacaatacctgaattttctgaggaggctgaaagtctaaccaattctcatgaagaaccccaaatagcacctcctgaagataacttggaatcctgtgttatgatgaatgatgttttagaaactttgcctcatattgaagttaagatagaagggaagtcagaatcaccccaggaagaaatgacagttgttatcgatcagttagaagtctgtgactctcttattccttccacttcatctatgactcatgtcagtgacacagaacataaggagtcagaaactgcagtagagaccagtacccccaaaataaaaacagggtcatcttctctagaaggccagtttccaaatgaaggaattgctatagatatggagctacagagtgaccctgaagaacagctttcagaaaatgcctgcatctctgaaacgtccttttcttctgagagcccagagggagcctgtaccagcctgccttctccaggaggggaaacacagtccacatcagaagaatcatgtactccagcctcccttgagacaacattttgttctgaggtatctagcactgaaaatacagacaaatacaaccagagaaattccactgatgaaaactttcatgcatctttgatgtcagaaatatctccaatatccacttcacctgaaatatcagaagcatctcttatgtccaacttaccattaacatctgaagcatcaccagtatccaacttacctttaacatcagaaacctcaccgatgtctgacttacctttaacatcagaaacttcttcagtgtcttccatgcttctcacctctgagaccacttttgtatccagtttgccacttccttcagaaacatctccaatttccaactcttccataaatgagagaatggcacatcagcaaagaaagtcaccttctgtatctgaagagccactctccccgcagaaagatgagtcttccgccactgccaaacctctgggagagaaccttacctcccagcagaagaatctgtctaatactcccgaacccatcataatgagttcttcttccattgctcctgaagcatttccgtctgaagatttgcacaataagaccctgagtcagcaaacctgtaaatcacatgttgacactgagaagccctaccctgcttcaattccagaacttgcttctactgaaatgataaaagttaaaaatcatagcgtcctgcaaagaacagaaaaaaaagtgttaccttcaccattggaattatctgtcttttctgaagggacagataataagggaaatgagcttccatctgctaaattacaggacaagcaatatatctcatcagtggataaggctccattttcagaaggctctagaaataaaacacataagcaagggagtacacagagtcggttagaaacctcacatacttccaagtcatcagagccctccaagtcacctgatgggataagaaatgaaagtagagattcagagatatcaaagagaaaaactgcagagcaacacagctttggaatctgtaaggaaaagagagctaggatagaagatgatcagtcaacccggaacatatcatctagcagcccacctgagaaagaacagcctcccagagaggaaccaagggttccccctctcaagattcagctttccaaaattgggccaccttttataatcaagagccaaccagtctccaaacctgagtctcgagcatccactagcacatctgtcagtggcgggaggaacacaggagccaggaccctcgcagatatcaaggcccgggcccaacaagctcgggcccagcgagaggctgctgcagctgctgctgtggctgctgcagcgagcattgtctctggagccatgggaagtccaggagagggtggaaagacgagaactctggcacacatcaaagagcagacaaaggctaagctctttgcaaagcatcaagctcgagcccatctcttccagacctctaaagagacccggttgcctcctccgctcagctcaaaggaagggcctccaaacttagaagtctcttctacccctgaaacaaaaatggaaggttcgactggtgtcattattgtcaatccaaactgtagatctcctagcaacaagtctgcccacctccgggagaccaccactgtactacagcagtctcttaacccaagtaaacttccagaaactgccactgacttatctgtgcatagttctgatgaaaacatacctgtgtcacatttatctgagaaaattgtttcatctacctcttctgaaaatagcagtgtgcccatgctttttaataaaaattctgtccctgtatctgtttgcagcactgctatatcgggagcaattaaagaacatccctttgtgagttctgttgataaatcctctgtcctaatgtctgttgacagtgcaaacactacaatttctgcttgtaatataagcatgttaaaaaccatccagggaactgacactccatgcatagccattataccaaaatgtattgaaagcactcccatttcagccactacagagggctccagcatatcaagctccatggatgataagcagttactaatatcaagcagcagtgctagtaacttagtctccactcagtacacctctgtgccaactccctccatcggaaacaatttgccaaacctctccactagctctgtcttgattcccccaatgggaattaacaacagatttccttctgagaagatagccatacctgggagtgaagaacaggccactgtatccatgggtaccactgtgagagcagccctcagctgcagtgattctgtagcggtcacagactctctggttgcacacccgaccgtcgcaatgtttactggaaacatgctgacaataaactcttatgatagtcctcccaagttaagtgctgaaagcttggacaaaaattcagggcctcgaaacagggcagataattctggaaaacctcagcaaccaccagggggctttgcaccagcagccataaaccgatcaattccgtgtaaagtcatcgttgaccacagcaccacgctgacctccagtttgtctctgactgtctccgttgaaagctcagaagccagcttggacctgcagggcagaccagtgaggacagaggcatccgtacagcccgtggcgtgtcctcaggtgtctgtgattagcaggcctgagccagttgccaacgaaggtatagatcacagttccactttcattgctgcttcggcagcaaaacaagacagtaaaacattgccggccacctgcacaagtctccgagaattaccccttgttccagataaattaaatgagccgactgctcccagtcataactttgctgagcaggcacgtggcccagctcctttcaaaagtgaagcagacacaacctgtagcaatcagtataacccaagtaaccggatttgctggaatgatgatgggatgaggagcacaggacagcctctggttactcactcgggttcaagtaaacaaaaagaatatctagagcaaagctgtccaaaggctatcaaaactgaacatgccaactacttgaacgtgtcagaacttcatcccaggaatcttgtaacaaatgttgctcttcctgtgaaatctgaacttcacgaagcagacaagggctttagaatggacactgaagacttccctggccctgagctgcctcctccggctgcagagggagcctctagtgtacaacaaacacagaacatgaaagcttccacctcaagtcccatggaagaggctatttccttggctaccgatgccctgaagagagtccctggtgcagggagctcaggctgtcgtctgtcctctgtggaggctaacaatccgctggtgacgcagttactacagggcaacctgcctttggaaaaagtgttgccacagcccagattgggagccaagcttgaaatcaacaggcttccattgcctcttcaaactacctcagtgggtaaaacagcaccagagagaaacgttgaaattccgcccagctctccaaatccagatggtaagggctacttggcagggactctggcaccactccaaatgagaaagcgagaaaaccaccccaaaaagagagtagctaggactgtaggagaacacactcaagttaaatgtgaaccaggaaaattgttggtggagccagatgttaaaggggtgccttgtgtcatcagttccggcatcagtcagctaggacacagccagccatttaagcaagaatggctaaacaagcactccatgcagaacagaattgttcacagccctgaggtcaaacagcaaaagcggctgctcccctcgtgtagcttccagcagaacctatttcatgttgacaagaatggcggcttccacactgacgctggtacctcacacagacagcagttttaccaaatgcctgtggctgccaggggccccattcctactgcagctctgttacaggcctcttccaagaccccagtggggtgtaatgcatttgccttcaacaggcatcttgaacagaagggattgggagaggttagtctttcctcagcacctcaccagctaaggttagccaacatgttatcccccaatatgcccatgaaagaaggtgatgaggtgggaggcactgcacacacaatgccaaacaaagcactagtacatccgccgccgccaccgcctccccctccccctccacccttggctttgcccccgcctccccccccaccacctccgctacctccacctctccctaatgcagaagtcccatctgatcaaaaacaacctccagttaccatggaaaccactaagagacttagttggccacagtccacgggcatatgtagcaatataaaatcggaacctctttcttttgaggaaggtttaagcagcagctgtgaactgggcatgaaacaagtttcctatgaccagaatgaaatgaaagaacagttaaaagcattcgcgctaaaaagtgcagatttctcttcctatttgctttctgagccacaaaagccttttacccaattagctgctcagaaaatgcaggtgcagcaacaacagcagctctgtggaaattatccaacaatacactttggtagcacgagtttcaaaagggcagcatctgcaattgaaaagtccattgggattttgggaagtggctccaatcctgccacaggcttgtctggtcagaacgctcagatgcccgttcagaactttgccgacagcagcaatgcagatgaattggaactgaaatgctcttgccggctgaaagccatgattgtgtgcaaaggctgtggggccttctgccatgacgactgcataggtccttcaaaactttgtgtagcatgcctggttgtacgataagagctgagtgaaagatgcagtatcccttttccacacggaaaagccaaatagcatcagcaacaacaaatagaataatgcagtggtttctatcatgctaatttattttgctttggagcaggtacctttcctctatggcattattttcttgcatttctcataaaggggaggatgcatcccaactgaatggctcactggcatgtcttttatgtgttcagttgccattcctagctttggaaagtttctatctgtccatgtgtatacaagtcaatgccccatttttgtttttcttttaaccgaggtgtagataggaaaaggacatttttaattacttaataaccggaaatgcagatgtgtaaggagaatgagaggaatgagttaaagtggttatgcatttttctatagatgagccattacagcaaggaattttacagttgacttctctgaacctagctttaccacagtgattaaatcctatttagaaaggggaatctgatttaaatgtgtgattccttgtatttgctcctatcacaaaagatatattaaaggaggtatgccattaatgaaatccactgtcctgagtattatctttcctcctgttgtactttctcagagactatggcagaatatctggatcttccttggattttgtacacatattgtagtgaaatgtgtcctacatctgaaattgcatgggactcatgcccagcaatctggttctaggcctttgacacctgataatatgagagcaattggccagccaatagccataagcccagaggattttagagcttcatgtgtggcttttaagagcaggtttg

SEQ ID NO: 1129 - DNA, 4032 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagc

SEQ ID NO: 1130 - DNA, 4743 bp, Homo sapiens
gggggcggggaggccgctgcggcgccgagggcgtcttggaggggtccccgcggggccttcggcctgggccgagccggggagcgagggcgccgcagatctttcatcgggataggaccccggggactaggcttttcccgggccgctcgttcctggccggcttgtgggctgcaggggtgggggcggaggaggacgaccctggctggacgctggtcagcatcctgcttgtgagaccggttccgcggtccgcagcgctggtggctgcaaggtttgtgtacggacgcatctgtcggctctcgtatttaaaaacgacggcttctgccaaaagagaaaagccatatctgccgacggacgctcgagagataatcgtggaactttatcagcgatggggctgttggtcacctttgccctccctctcttttcttttttcttaatcttttattttcgttttttgggagatgtcagagggcctttccctgttaggatgacttttatctttgctcttgtaatggctcaagatagttgggaggtaatttgcattcactttatgcatacccaccttgaaaaacgtattttggttcgcctgaaactgttgttggtttgagcataatttatgtttagaaagacaaaaagcaattgtcatatctccaaagaccaaagacatagctgatagctgtatgcattactggggccttttgagcagctgcttctgcaagaggacatccggagacacaggaatagaaatgatccgatcagagtaattaaaggcttttaactgagctctgaggtcccaaacagggcacactccgtcagcctaaagctgtgaagaagaaccttcaacataaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccaggatgcacctctctctgactgtacggaaactatcgaagggctcgagcttacagagcagacctttagtcccgctaaatctctctcttttagaaagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaa

SEQ ID NO: 1131 - DNA, 2361 bp, Homo sapiens
gaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctga

SEQ ID NO: 1132 - DNA, 1391 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaacaagcagcagcgggagaagacaagatggctga

SEQ ID NO: 1133 - DNA, 4068 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaa

SEQ ID NO: 1134 - DNA, 3787 bp, Homo sapiens
gaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaa

SEQ ID NO: 1135 - DNA, 3939 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagc

SEQ ID NO: 1136 - DNA, 671 bp, Homo sapiens
ggagccggagccggagccgacgggcggtggccgcactgggaccccggaatcccgcgcgctgcccacgattcgcttctgaggggccttttgagcagctgcttctgcaagaggacatccggagacacaggaatagaaatgatccgatcagagtaattaaaggcttttaactgagctctgaggtcccaaacagggcacactccgtcagcctaaagctgtgaagaagaaccttcaacataaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgta

SEQ ID NO: 1137 - DNA, 3107 bp, Homo sapiens
ggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagcaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggc

SEQ ID NO: 1138 - DNA, 1332 bp, Homo sapiens
aggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcg

SEQ ID NO: 1139 - DNA, 5856 bp, Homo sapiens
gggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctggatttgaatccaggtcagtctgagtccagagcccttgctcttaacagctatggtgaacagacaactttaatccccaggggtggtggttttcatccaggatttgtctctatgactgttctccattgcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgcagccttttgtgtgcgagttgttctacttcgggggtgatgttgattgcctctgcattcaacacactctattcccttgacaatgaggcctcacttaggcctcattgggtggagtcttgctgcagcattattctgggaatttatgccatgggcccactttctattgatagatgaacctgtcagttggttcattcctcatgcattccaaaaacatgcattgagcttgggtcaagggccaggcatgaggataggcatagttcctgccctcaagaagttcatgagcataggaggtgtatagacaaattgcaaaacaggcaagggtaccaaggtggcataagaaagcatcaattaactatcttggggaccagagaaaccctgagagaagcaatggctgctaaggttttaaaacaaagagtaaatttccagtagaatgaaaggattggcagggcatgccacaatgagggaagaatgtgcaaaggtgtggacgcatgaaatgccatgatgggttccgctgagcaacgtggcattgccagagcatgatgtggaagctcaggggttgaggggtcccttcataggtaggcagggctgaatcctaaggaaactggtaggaagtgtggaggagctagacttgtcatggaaggggtttggagccactggagcctttaaatcaggatagagtcatgatcagaattgcattttaggaaaatccctttggtggctgaatggagactgtggactggatgggcgtgggatggtggcatgggagctatgaggcctttttgaaatgtcaatactaaaacatagttgatggcctgctttacacgatgtttcctctacagcagatagtgagtttccaacacaaaatttatttccataaaagtctttggataaagcaccttaagagggattttcaacaaggagaggggagcattcaaagagctaatgtttccagttttattttgtcttggtgtagaattgctgggagaggtgtccagccatcctgccatttct

SEQ ID NO: 1140 - DNA, 739 bp, Homo sapiens
gggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggagtacaagaaagaggtggagaggaagaaactagaacttgatgctcctggctggttctcttca

SEQ ID NO: 1141 - DNA, 2226 bp, Homo sapiens
atttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatgctcctggctggttctcttca

SEQ ID NO: 1142 - DNA, 3745 bp, Homo sapiens
catttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcagattacctgagactgggtcatttataatgaacacagatttatttctctcacatctggaagctgggaagtccaagatcaaggcaccagcatttggtgaagccttctttctgtgtcatcccatggcagaagacagaagggcaagagaggaaaccggtccaagcaggatgccttcctttttctgacaggcagcccccagcagtaccatcacaaaccttggtctcttcttgtcaccagcaaagggatgaaggataagtgatgaggagactgaagcacagaggtgaagcagcttgcccaacgtcacactgctgcttagtgatagaggcagtgctagaccccggggctcctgaatgttactgttggaggctcttaacccactgggatcaagaaggtgtcaagagctagactctccctccaggagaatgaacacagacacaaaaccttgcatatatgcttccgggtaaagaacctgcctgcattttggtaccactacgtgctggcctgtcctgggcatgttatatcatgagaaggcagggaaggctgaatcattaaggacatgaatcagattgattctcgtggctttaaaaacaaacactacaggaccagcatgacccgccagcctgttatccacagaggcttgtggtctccattgaaaagaagcaaagacagcacgtcccaactcaaaagattgtgtcatcctaaaggtgaaaggaagagatgatccaagcaaatttaggaccaatagcagactcttcacactgcctggggatagagggaccaccctgggctcctcttactcctggatttacttggatgaccagactcaggacttcatttaaatagaatttggtttcataatggaatcttcagcttgaaatataaatttgtttctgtctccctctgccatctcagcctttcttg

SEQ ID NO: 1143 - DNA, 3741 bp, Homo sapiens
aaaggtttctggtgatgatgtagcatccgaggctcttaggaaatcggggctgcaagcactggcccctgcttggggatggtgggaccctcgcccggagcgtaacgcctgacagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaa

SEQ ID NO: 1144 - DNA, 3776 bp, Homo sapiens
gccaggagagctctcatttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttcggggtcttctgtgcctggggctgggttgcaggacccctgagtcctcatacccaccttcccctgtgatcttgggtgccggtgctcttgctgcaaaatggaggccaacctcacaggggtgctgtgaggaccagggaggacaatgtctgatggcccctgtgggcactgggctggagaacagcagcccagcctgcctgcaggagtgatgcggccggcttccgtacctcctgccatggaactccactctgtcctcccttactaccccgtgaagtggggactcataggcttggggctggagactcccaggtgccccaggtgtgcccagccctgagagtctctgacctctgagcctggtatgacatcatccaaccagagctctggaaagatgatcatgtacccatagagaaggggtatatagacaggacccatgctcctacaggatgggaagggacaatattacccacacaaacccacattgagttagaaagtattgtaattgtttttgtgcttgagatagaacagtgttttgtctagtgcttagcaaaaggggtgaagttcagaattctggcatgtgtttgaaatcactgctgctccttgcaaggtagcaatgggcatgacattttccttagcagtaaaaattggggaaatacaggaaatgttcctctctgcagggcaaattgtgatgatgcaatgatttcaggtcaagactgcagcccacagggtgggtgcccattggcaggagaagtgtgaaagttgtatcatcacacttacctccccccaaccccaactcagccaagatggggaacactgaatatcccgcagggtcaagtatagaaatagccatgttctggcgggaggtgagagttcattacaatgagcaacactgttaaaaaaacaaacaaaaatctcccctgccatttataccaagtgctcttctcggagtccctcttcttgggtttttggtcttggattctcggttgactccatgattccctacattaggcctactgtggcctcccttttggaaggggcccaggggcagaagacctggcgggccagggcagggaggactggcagcctccaggctcacctccctttggcttcactctctttgctcctcagcttcagagcactgcatcctcaaaggccaagatgaggatgctgaattaggaaaaaaggctgtggagtctgaattttagttcctatcttgggctagaggggtcaaagaattcctgaagcttatgtaagggccggctggtcagctccctagaaccacgggctccacagaggtggcaaaacccagtgattttgccagtatccctgcagggacctgcggtacaggcaggttgaagatctgagactcaggaaccttggcccctttgtcacttacaactgtgtgtgaaacaggactaacagtttggactgagagcactgaagctgctgtgtgttgtgcatataacttaatgctgtgtgttgtggcttgcactgctgtgggggcggggagggcagtggtggggaatggctggcatgaagcttgcttgagccaatgctatgcttgctgggctttggctgactggctttgggccaccaactgtatttgcatagtgatggcttggaagtgtccatagaagggattgcaataaaggtgtgtcttccttc

SEQ ID NO: 1145 - DNA, 930 bp, Homo sapiens
tcccttattcaactgtcttcatttattctgtaaaagtagcagcagctcagccctgaccatctcctctctcacttgtgggagtctcatttagggatcgtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatcca

SEQ ID NO: 1146 - DNA, 721 bp, Homo sapiens
cggtgcgaggcgggcttggcggggctgggcgcgtcccccggggcctcgcgatcgctggctgcgcggcgctcagccgcagtggccggccgagcaggtgcggcgtcggcagccgcctacattgagatcggggcaaccggcactttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgact

SEQ ID NO: 1147 - DNA, 2332 bp, Homo sapiens
atttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttcggggtcttctgtgcctggggctgggttgcaggacccctgagtcctcatacccaccttcccctgtgatcttgggtgccggtgctcttgctgcaaaatggaggccaacctcacaggggtgctgtgaggaccagggaggacaatgtctgatggcccctgtgggcactgggctggagaacagcagcccagcctgcctgcaggagtgatgcggccggcttccgtacctcctgccatggaactccactctgtcctcccttactaccccgtgaagtggggactcataggcttggggctggagactcccaggtgccccaggtgtgcccagccctgagagtctctgacctctgag

SEQ ID NO: 1148 - DNA, 580 bp, Homo sapiens
tttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagagcaccactaacacgaagctcttctgcacatcagactcttaatcaaaggattgggcatatcagaagtttccacctggatgtttgaggttgtgtagatgtggccggcacccttgagagtggagctagggggtgcagactgagcagtgaacagaaggagccttggacagggctgggccagcctcccgttccaggagcgaattgcaaacccaccgggaaaatgagcgaagagacggtccccgaggctgcctcgccgccgcccccgcaggggc

SEQ ID NO: 1149 - DNA, 1308 bp, Homo sapiens
atttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctggtgagtgaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatgctcctggctggttctcttca

SEQ ID NO: 1150 - DNA, 2654 bp, Homo sapiens
gggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatgagacaggacaggaacgagagccaggctctggtccggccgtgtgcgagttcttcagcgttgccctccacatctggagtaacatattggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaa

SEQ ID NO: 1151 - DNA, 4337 bp, Homo sapiens
ggcgctcggctagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 1152 - DNA, 3081 bp, Homo sapiens
ggggcgctcggctagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagatgctgagcaggaattactctcagatgacgcttcatctgtttcacaaattcagtctcaaactcagtcaccgcaaaatgtccctgaaaaattagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaa

SEQ ID NO: 1153 - DNA, 3114 bp, Homo sapiens
agtccacaaaactccctgattccatcctctctgcctcttatgaagcaatactagagaggaaaaacaaaacccattcctttaagaaagattccgcctcctctcataagcaagcgcctaatggtaattgtagagtttactaagtcaaacacttactactcagcattgagagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggc

SEQ ID NO: 1154 - DNA, 807 bp, Homo sapiens
gcgctcgggctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 1155 - DNA, 673 bp, Homo sapiens
gcgctcgggctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 1156 - DNA, 10151 bp, Homo sapiens
gcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcggacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgcc

SEQ ID NO: 1157 - DNA, 9329 bp, Homo sapiens
gcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcggacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgcc

SEQ ID NO: 1158 - DNA, 11650 bp, Homo sapiens
gggtttggggagcaggaggcagacatgtgttgctttgcacgtcatctggtccttccacctggctgggcatgggatggtgacctcagctggaacatggggctcgagccagaccccagggtctccctgcgtgtagcccccaaccccaagcctgatccccactggagacctgaacagccttggacatcatcggatcagggtgggaggtgccagcctctgccacctgacttccagtccctgtgcccctcccaccctgcccttgggcactcctgccctgcaggttcctcagaggggcaacccaaagccagagaggggcgggtcttgtcgggcctccagcctggacttcccagcccctctggggcagcatctgggtgccagacctcggttcctagggcctcgtttctccctctgggaacagccaaatggtggtccctgagactcaggacagaccaagaaggagccggatgacatggcaagccacacactgcgtcccctgagcaggacgggacagcccgactccatcctcccacctgcgactgagcccccacccctactcctgtcccagccgtgcccctggtgacatttgggtgggaggggaggggatgagggggcacctgggggtcagagaacaaatgacgggtgaatacatgtgtgtggccaggtggaggagggaggggaggagcaggtgggctggacagggccggtgtgaggaaggggctcaggctggcagggggaggtggcagagggatgggctgccattggtgcgtctgagacaaaggcggagggaggaggcgagcgctgatgggaaaggaacaaagagggaaggggggcgtgaaggggggctccggcgggagggccgagccgagggaggaggcgccggccagctggacagagggaggaggccaggccagagccagaagacggccagaggcacaaagaagccagcgcgctggcagagtcaagggatggggcaggggctgccggggccagcagggaccagctgaaggctgcgcagggggtgcgggccacacaggtagccaccctgagctcagccaccgatggagggtcgtggggctgctgcggtgatggcggtgggcttgggtccatctgtcctgccgtttctgcacagcttaggtgtcacccactggccttcgtggtgttttcattgtccatcggcagggacagctggtggtctgtccgccccgcgtgtctggctgtcagcctctgggcaggcttgcttttatgggggagggtcctgtctgtctgtctgtcgccctctctggctgtgagcctgggggtgctgggctggccagtcggcttgctgggttaggctgtcccagctgtctgtgtgtttgtccggctgtcaggatgtgtcctgggggctgggaaggagaggccgacccatcgtctgtcggtcgactggtcagttggacgttcagctgtctgtacgtctgtctgctggcccctctgtctccccttggggccacctctcactccacctgcccctctgcgccccggattgcctggccaccaccacgtgggcctgtacttgtccacaccagtgactcctgcctgagaccccccccaacccaggatcaggcaggacggctggggcttaggtcaggggccgtctgtccggaaggcatcaccgcgccctccccagaccatcagctgaaccctctgaccctgtgatcccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgc

SEQ ID NO: 1159 - DNA, 2562 bp, Homo sapiens
gaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaaccta

SEQ ID NO: 1160 - DNA, 2360 bp, Homo sapiens
atgaagagacgctgcagctgcggtggcggtggcggccactgcagctcagagcggcgccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacct

SEQ ID NO: 1161 - DNA, 2896 bp, Homo sapiens
atgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccct

SEQ ID NO: 1162 - DNA, 2919 bp, Homo sapiens
gtgcggagcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctg

SEQ ID NO: 1163 - DNA, 2219 bp, Homo sapiens
cggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggagaataagccaatgcatggcaagcactaaatcttagatcctgaagactcagccctcgagcaaaagacatgcacctccccactcaccgggccctggaagaggagggtgctcctcttagaggcccctggaggccaggcgtgcctcagaggggcctttcgaggcagctgggaggcagatcctcacactctgccctcctctcccccaggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctc

SEQ ID NO: 1164 - DNA, 3407 bp, Homo sapiens
aacatgaggggattggactggatgccttatggcttagcgctgtgctatgaagaggaagaaggaggaaggaaaaggagcgcagagcgggttacactgccaggagatcctgggaagctaggtcacttccctgagcctcagcatccttatctgcaaaatagaaattgctaatagactaaaaggcaattctgaaagatggatgagaaaggaatataatgactcagggtagagcctgcaaaacaatatgggatgagaagatgcagggactggtttcatggagagagcagggttttaggattgggggagggtgccagggctaccgactgctttgggagatcccagagggggcattctgaagtcctgcagaagagatgctgtgccgtgaggggtgaggggtcgctggaggccagaccagggctcccaggagtcctgcattgagaagggagagagtggacacaggaaggatgcgcctctgtccagtcctgaggctgggcgcacacaccaggcccttcgaaaagctcacattttttccagcttttctcacccagtatcacttcctttgttaagaggagggggtgggggaggagacggaggatgaggagggaggggctggcgggtgccgccgccgcccccgccccctcccggtgtgcggagcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctg

SEQ ID NO: 1165 - DNA, 2560 bp, Homo sapiens
gtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgaagcctcgtgtgagggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaa

SEQ ID NO: 1166 - DNA, 1963 bp, Homo sapiens
gagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggaaaaaaacagaccacatctgatccttggccctgagtccagagtgggaggcaccgtgacaacaatgcgcagagcagggaatgcagggagccatggatagtgctggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccag

SEQ ID NO: 1167 - DNA, 569 bp, Homo sapiens
gactcccaggcccgaggactcctggaagggaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcac

SEQ ID NO: 1168 - DNA, 669 bp, Homo sapiens
cacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatca

SEQ ID NO: 1169 - DNA, 560 bp, Homo sapiens
attggaccaggggaaccagccttgctcagtgacttctctgggtgtcctcctctaaagtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctg

SEQ ID NO: 1170 - DNA, 1517 bp, Homo sapiens
ccgcgcgctcgcatgaaccttcgcgagctcctccagcagggatggaccgggggcgcagaggcgcttcctgaggggtggcgggccgggccccggggcgagggagattccccaggtggaggagccgggcggagaccggttccccgggaaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctg

SEQ ID NO: 1171 - DNA, 2460 bp, Homo sapiens
gtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgtttt

SEQ ID NO: 1172 - DNA, 1735 bp, Homo sapiens
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgta

SEQ ID NO: 1173 - DNA, 1884 bp, Homo sapiens
ctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgagaatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctatcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcttgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcccttgtcctttctctctaattcagtgttttggaggcctgacttggggacaacgtattattgatattattgtctgttttccttcttcccaatagaagaataagtcatggagcctgaagggtgcctagttgacttactgacaaaaggctccagttgggctgaacatgtgtgtggtggtgactcatttccataccattgtggaattgagcagagaacctgctctcggaggatgcctaggagatgttgggaacagaaaaaataaactgagtttaagggggacttaaactgctgaattcacctgtggatgtttttgagtaaataaaagctaatagctaa

SEQ ID NO: 1174 - DNA, 897 bp, Homo sapiens
ggtagagaccaccagttggaccaatggaagggtctccagcaggacccattgagcagaaggaggccaggtgggaaagctcctgggaagagcagccagactggacactgggctgcttgagtcctgagtcacacaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatg

SEQ ID NO: 1175 - DNA, 1517 bp, Homo sapiens
gcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagattcagaattcctgggctccctgggtgcattctatcattccagttgaaagtttgcttccttccagtcatgtggctcttcattctactctccttggctctcatttcagatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaa

SEQ ID NO: 1176 - DNA, 1150 bp, Homo sapiens
agttggaccaatggaagggtctccagcaggacccattgagcagaaggaggccaggtgggaaagctcctgggaagagcagccagactggacactgggctgcttgagtcctgagtcacaattcagaattcctgggctccctgggtgcattctatcattccagttgaaagtttgcttccttccagtcatgtggctcttcattctactctccttggctctcatttcagatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaa

SEQ ID NO: 1177 - DNA, 962 bp, Homo sapiens
agcctcaggctcttcaaggccctccgtcaagcaatgatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaa

SEQ ID NO: 1178 - DNA, 345 bp, Homo sapiens
ttccttccagtcatgtggctcttcattctactctccttggctctcatttcagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgg

SEQ ID NO: 1179 - DNA, 637 bp, Homo sapiens
ggacccattgagcagaaggaggccaggtgggaaagctcctgggaagagcagccagactggacactgggctgcttgagtcctgagtcacacaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctcta

SEQ ID NO: 1180 - DNA, 1539 bp, Homo sapiens
ggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtggaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgca

SEQ ID NO: 1181 - DNA, 1961 bp, Homo sapiens
aaacaggaaggccacagtggaggccaagccttccccatgggcaccttctcagattgcgattgtggatgaaatgagggattttcttgaaacaaccctcacgcaggtgacgcaagacgcggagctcggctgcacgacgctggcgcaagcgcgggggcaagagcgccggcctccgagacggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttaggtacttttatagacaacttctgctcttctacagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtg

SEQ ID NO: 1182 - DNA, 1912 bp, Homo sapiens
acggttagtgattggacgaagcagggcgcgggggcgcaagcccgggtcctgcaggggcgacgcgaggcctcttttgaaagatgcggccctgaccctgtgaacctcgcgcagagcggcctgaagcgagaggttgaggctgggaggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtgtgttttgactagtaaaaa

SEQ ID NO: 1183 - DNA, 977 bp, Homo sapiens
gagacggttagtgattggacgaagcagggcgcgggggcgcaagcccgggtcctgcaggggcgacgcgaggcctcttttgaaagatgcggccctgaccctgtgaacctcgcgcagagcggcctgaagcgagaggttgaggctgggaggtgggagcaacggcggcggcggccgcctgcgagcccccggcctgaggcgcagcagcagctgcccgtcttcccacatagagggcaggaaggacaactttggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagag

SEQ ID NO: 1184 - DNA, 627 bp, Homo sapiens
gttcgctcactggccaagcttcaggacgtgtgaggtagtttttctgtaaacaggaaggccacagtggaggccaagccttccccatgggcaccttctcagattgcgattgtggatgaaatgagggattttcttgaaacaaccctcacgcaggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaat

SEQ ID NO: 1185 - DNA, 1918 bp, Homo sapiens
ttgaaagatgcggccctgaccctgtgaacctcgcgcagagcggcctgaagcgagaggttgaggctgggaggtgggagcaacggcggcggcggccgcctgcgagcccccggcctgaggcgcagcagcagctgcccgtcttcccacatagagggcaggaaggacaactttgagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttaggtacttttatagacaacttctgctcttctacagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtg

SEQ ID NO: 1186 - DNA, 6554 bp, Homo sapiens
atgatgtcaccaatctgcgaccagaccattgattcccgactgaaggtagagaaggctacgtggtgggggagggtggggggagggtcgcggccgcactggcagtctccgggtgtccggccgtgtcccgaggaagtgcaagacccggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattctt

SEQ ID NO: 1187 - DNA, 2519 bp, Homo sapiens
gcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagcataattgatatactgtggttactctacctatttgtgtaggcctctcaggtcattgaaacaagatgttgtacaaattagcagatgacactggcgcatggaggaatggtttgtattttaattttcactgtataacattttagtaaagcttttactgcaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttgagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaaggaagctgtcagtgtggtgttgggcctgattgattcgcatcagctcaggtggcgtcctattggaaggtcggcagtgggagagcagctggccagttcctcccgcctgcaaggcaggggagtgtacaaggtgtgtaccccaggggcaggatgctaacactgcactgactgagaaaagaatttgtcttacctgtacctgacaggtgtgtacctgaaagagatgaaattgaaatggccaatgagcacaccctcattcatccagcgagcattgaggaccccctagaggccaggcccatgagtgatgaagatcccgaggatgaagacgccttgccagccaggtggaagaaagaaatgggaagaaaaaggaagagaaccatagctacgttgtgagggcattgcttcaactctggtaacttcatgtgaaatgactacaaaatgaattaatatgcagtaagagagccagtgccccaccagggcacctttccacttgctggcacacagatttaccacaattaggatactgcttgtcctgtcatgccgggagagtctaaattactctgactttcaagaaaccaaaaatatgcatttttgatgttaggaagatttactgtgcattgggctgtgtcatttgatgaggaaaaaaccaaatgatctctttatgaaaatgaagaattgtagcctgtggaggtgaccaaggaaccagatcccaagaggcctctgccactgaaaggagatttttattacttgcgtttcctagacgggggggcactcgcgccaagcaggcccacggggcacactggtgtcagtcaaggggcagaaaggagccacaggaaagcccaggacagagcctgagtggggtttctgtgggaaaggcagggcagggcacccgtgtaggaatggctagtgtgaacagttccagtgggccctgggctgtaggagagatcactagctgcctgctaccaggccctggggtgatttcgggcaggcgggcagttagataagggaggtgggtagagccgaccacctgcctggaaccctgtgctggctataagccctgggagggccagtctctccctgtgtctgtaaggcccacaaatgccaaagcattaggaataagaaaatggacgtaatagaattgatcctgtgaggactggatgcctaactgccacatacagaatgtgagaaagcacagaacaactgccttcattgacaagatggtgcccagagctcaagacaggcacacagcaggaggatgccggcaggatccctcaacaagcttaccgtggtatctttcacaatgttaactgtcatcccagatgaacttttaatgacagtgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttatggtttcggacttacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatg

SEQ ID NO: 1188 - DNA, 6882 bp, Homo sapiens
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggagccctgggcggggcggctgttggggggaactgggttcggggtgccctgggcagggggctactggggggcggctgtgaggaggagttgggttcagggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 1189 - DNA, 6604 bp, Homo sapiens
caaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggagccctgggcggggcggctgttggggggaactgggttcggggtgccctgggcagggggctactggggggcggctgtgaggaggagttgggttcagggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 1190 - DNA, 3563 bp, Homo sapiens
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 1191 - DNA, 3977 bp, Homo sapiens
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcact

SEQ ID NO: 1192 - DNA, 704 bp, Homo sapiens
aaatgtcgctgttcagtgcgttgatcgattctcacatctgaagccagctgtgtattcttgagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtcttt

SEQ ID NO: 1193 - DNA, 5033 bp, Homo sapiens
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 1194 - DNA, 7027 bp, Homo sapiens
ctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggagccctgggcggggcggctgttggggggaactgggttcggggtgccctgggcagggggctactggggggcggctgtgaggaggagttgggttcagggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactactc

SEQ ID NO: 1195 - DNA, 5056 bp, Homo sapiens
ctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctgggcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactactc

SEQ ID NO: 1196 - DNA, 703 bp, Homo sapiens
agaaaagagagcagcatttgttagcacacatgggcctgtggagcccagtcccaggcaacagtgtccccagagccccagtgatggctgggttgggtctggggcactcccagggagctccccaaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggag

SEQ ID NO: 1197 - DNA, 1810 bp, Homo sapiens
acacatgggcctgtggagcccagtcccaggcaacagtgtccccagagccccagtgatggctgggttgggtctggggcactcccagggagctccccaaggtccgcacgatgggaagactgacaggtcctcaggaccaggccgcagacggacagagaggaccaggctccctgggctcctgggtggggctccgctgactgctggctctccccacaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtacgacattaccgaacacctaaaatagaaccagagaaacgaaagccattcccacaaagtgaaggaacagtttccaaaacccctgcgaggcagagttaagacctgtgacgtggggagcctggaaacacccggcccacgcgtgctgcagatgtggggagcctggaaacacccggcccacgcgtgctgcagatgtggggagcctggaaacacccggcccacgcgtgctgcagatgtggggagtctggaaacacccggcccacgcgtgctgcagatgtggggagcccggaaacacctggcccatgcctgttcagtccgtcatggcgtttggtttatggtggccgatactaagagccactgaggtctgggttgtgtaagggttagctaccaccctataacctccctaccaggtaataaggagaccaagtctttgatcaaattctgattttttaactaaattttcattagaaagcaagcacaaaataaaatcaaaacaacctttaccttc

SEQ ID NO: 1198 - DNA, 3606 bp, Homo sapiens
tgcgctgggagcccagagcaggaggcagagcccgcgggaagctcggagcactcaggacgccgcgcgcccttccccgccctccctgaccagggagcagctcgctccaggcgcccagccgaggcccccagcccagtgggagcaagtcatagagaacaattcgagagacagagagacggagcgcgctttcctgctcagtcctgaaaagtgagccgctcccgggtttgcaacctcaagcttcgcagcagcggcggcggcggctgccgggaaggaggcaggtgcaggtgcaggagggaggcggctctgggctccgcgcctgggtctcggccatggcctcggtcctggggagcggcagagggtctggagggctgagcagtcaactcaaatgcaagtccaagaggaggaggaggcggaggtccaagcggaaagataaagtaagcatattgtcaaccttcctcgctcctttcaagcacctgagtcctggcatcacaaacacggaggatgacgacaccctcagtaccagcagcgcggaggtgaaggagaaccgcaacgtgggcaacctggccgcgcggccaccgccctccggggaccgggcccggggcggcgcgcccggcgcgaagaggaagcggccgctggaggaggggaatgggggccacttgtgcaaactgcagctggtctggaagaagctgtcgtggtcggtggcgcccaagaacgcgctggtgcagctgcacgagctgaggccgggcctgcagtaccggacagtgtcgcagacgggcccggtgcatgccccggtcttcgcggtagcggtggaggtgaacgggctcacgttcgagggcacaggccccaccaagaagaaggccaagatgcgcgcggcggagctggcactcaggtccttcgtgcagttccccaacgcctgccaggcgcacctggccatgggcgggggcccgggccccggcacggacttcacctccgaccaggccgatttccccgacacgctcttccaggagttcgagcccccggcgccgcgccccggactcgcgggaggccgccccggggacgccgcgcttctgtccgcggcctacgggcgacggcggctgctgtgccgcgcgctggacctggtgggcccgacccccgccacccccgcggccccgggcgagcgcaaccccgtggtgctgctgaaccgcctgcgcgccgggctgcgctacgtgtgtctggcagaaccggccgagcggcgcgcgcggagcttcgtgatggccgtgagcgtggacggcaggacgttcgagggctcggggcgcagcaagaagctggcccggggtcaggccgcgcaggccgcactgcaggagctgttcgacatccagatgcccggccacgcgcccggcagggccaggaggacgccaatgccgcaggaattcgcagactccatatcccagctggtcacacagaagttccgcgaggtgacgacggacctcacgcccatgcacgcccgccataaagcgctggcaggaatcgtcatgaccaaaggcctggatgctcggcaggcgcaggtcgtggccctgtcctcggggaccaagtgcatcagcggcgagcacctcagtgaccaggggctggtggtgaatgactgccacgcggaggtcgtggcccggcgggcgttcctgcacttcctctacacgcagctggagctgcacctgagcaagcggcgcgaggactcagagcgatcgatattcgtgcggttaaaagaaggtggctaccggctgcgagagaacatcctcttccatctctacgtgagcacctccccctgtggagacgcaagactccactctccctacgagatcaccacagacctgcacagcagcaaacacctcgtcaggaagttccgcgggcacctgcgcaccaagatcgagtccggggaagggacggtccccgtgcgtggccccagcgcagtgcagacctgggacggcgtcctgctgggggagcagctgatcaccatgtcctgcacggacaagatcgccaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtacgacattaccgaacacctaaaatagaaccagagaaacgaaagccattcccacaaagtgaaggaacagtttccaaaacccctgcgaggcagagttaagacctgtgacgtggggagcctggaaacacccggcccacgcgtgctgcagatgtggggagcctggaaacacccggcccacgcgtgctgcagatgtggggagcctggaaacacccggcccacgcgtgctgcagatgtggggagtctggaaacacccggcccacgcgtgctgcagatgtggggagcccggaaacacctggcccatgcctgttcagtccgtcatggcgtttggtttatggtggccgatactaagagccactgaggtctgggttgtgtaagggttagctaccaccctataacctccctaccaggtaataaggagaccaagtctttgatcaaattctgattttttaactaaattttcattagaaagcaagcacaaaataaaatcaaaacaacctttaccttca

SEQ ID NO: 1199 - DNA, 1869 bp, Homo sapiens
gtgacgtcacgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggcccacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctca

SEQ ID NO: 1200 - DNA, 1608 bp, Homo sapiens
accggcggattaagctcgctttcttctaggcgcgtttcctgaaggtcgatggccaggtggtcttcataaactatactgccttgtgatgcctccctagaaatgagaggtctcaataccagctcagaccatgtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggcccacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgca

SEQ ID NO: 1201 - DNA, 1169 bp, Homo sapiens
gtggatggcagaggtgggctgtagagccaaagtggggtgggagcgcgaagatggcagctgctgaggaggagccgaagcccaaaaagctgaaggtggaggcgccgcaagcgctgagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagt

SEQ ID NO: 1202 - DNA, 2083 bp, Homo sapiens
cgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataa

SEQ ID NO: 1203 - DNA, 1249 bp, Homo sapiens
gatgcgaagagggggcgggaccagagagtggatggcagaggtgggctgtagagccaaagtggggtgggagcgcgaagatggcagctgctgaggaggagccgaagcccaaaaagctgaaggtggaggcgccgcaagcgctgagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttc

SEQ ID NO: 1204 - DNA, 1187 bp, Homo sapiens
agtcgctgagtgcctgagccgggaagcagttgctgtggtacctgctgctgcccgagcggacgtagagcatcggacgcgggcgccgtggcgctgggcaggagggcgaagccatgacgtcagtcagagaaaatattctctttggaatgggaaatcctctgcttgacatctctgctgtagtggacaaagatttccttgataagtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgcc

SEQ ID NO: 1205 - DNA, 2391 bp, Homo sapiens
acttagcagagaagaatcaaatttccgggggcaaagcaaaataataaaatgaatgtcaggatattttatagtgtcagtcagtcaccccacagtctcctctctcttcttttctactgtgctatcctagaatcaaggatttcagcaacaatgcctctgttcaaactcccagctgaagagaaacaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataa

SEQ ID NO: 1206 - DNA, 2375 bp, Homo sapiens
aaagcaaaataataaaatgaatgtcaggatattttatagtgtcagtcagtcaccccacagtctcctctctcttcttttctactgtgctatcctagaatcaaggatttcagcaacaatgcctctgttcaaactcccagctgaagagaaacaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaaccaaa

SEQ ID NO: 1207 - DNA, 2392 bp, Homo sapiens
acttagcagagaagaatcaaatttccgggggcaaagcaaaataataaaatgaatgtcaggatattttatagtgtcagtcagtcaccccacagtctcctctctcttcttttctactgtgctatcctagaatcaaggatttcagcaacaatgcctctgttcaaactcccagaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaacc

SEQ ID NO: 1208 - DNA, 3899 bp, Homo sapiens
gggtgctgggttttcacggagtatgcctgccctgccccgggaggactgtgtttgagcttggactcgctcgctgctgaattcctgtttgttattcttttttcttccaggctagctggaaggaccagctagcctggactttggcttctttgcccgggagccctggcatgatggggtgagggctcttggtgggttagtggagagctgggggctggcccttccccatcttcttttctacccaccccctccccgccccccgccaggcccagccaccatcagtcacgtcactcctgggactgaggaggcaggggagggataaggggcagagatggaggccccactccccgaggttgcctagacaacatgagaaatcgtggccagggcctcttccgcctgcggagccgctgcttcctgcatcagtcactcccgctgggggcggggcggaggaaggggttggatgtggcagagccaggccccagccggtgccgctcagactcccccgctgtcgccgccgtggtcccagccatggcatcctatccatctggctctggcaagcccaaggccaaatatccctttaagaagcgggccagcctgcaggcctccactgcagctccagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 1209 - DNA, 3728 bp, Homo sapiens
aagggccgcagagcctggcgcggagccggcgagattttggtggggtctcacctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 1210 - DNA, 2838 bp, Homo sapiens
ctcccgctgggggcggggcggaggaaggggttggatgtggcagagccaggccccagccggtgccgctcagactcccccgctgtcgccgccgtggtcccagccatggcatcctatccatctggctctggcaagcccaaggccaaatatccctttaagaagcgggccagcctgcaggcctccactgcagctccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagttta

SEQ ID NO: 1211 - DNA, 3217 bp, Homo sapiens
actctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagt

SEQ ID NO: 1212 - DNA, 513 bp, Homo sapiens
agagcctggcgcggagccggcgagattttggtggggtctcacctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcagggcctcttccgcctgcggagccgctgcttcctgcatcagtcactcccgctgggggcggggcggaggaaggggttggatgt

SEQ ID NO: 1213 - DNA, 3134 bp, Homo sapiens
cacctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcaggcccagccaccatcagtcacgtcactcctgggactgaggaggcaggggagggataaggggcagagatggaggccccactccccgaggttgcctagacaacatgagaaatcgtggccagggcctcttccgcctgcggagccgctgcttcctgcatcagtcactcccgctgggggcggggcggaggaaggggttggatgtggcagagccaggccccagccggtgccgctcagactcccccgctgtcgccgccgtggtcccagccatggcatcctatccatctggctctggcaagcccaaggccaaatatccctttaagaagcgggccagcctgcaggcctccactgcagctccagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatga

SEQ ID NO: 1214 - DNA, 572 bp, Homo sapiens
attactgtgcatacatcatcctgatgtctgtgacctcctgcctctgcctctatcgtcagttcctgtgcctttcctgtggctgtcccactttatgatcacatttacgaacagtttcctgatgaagtaaataagtgccagggcaggggcccttggagtgacttggctggggtctgtggcccgatccccctgccgtccctcaggacccgggctttctgctgtacagacttctcgtgggcagcctcccctcggaactcgggcatcatggcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagattt

SEQ ID NO: 1215 - DNA, 3680 bp, Homo sapiens
tcaaccctgcttggttttagaggattgctcctgtgggtcacttgaggcaggctccaccttccccaggaggagtggcagagtccagccagcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaa

SEQ ID NO: 1216 - DNA, 3806 bp, Homo sapiens
tgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaa

SEQ ID NO: 1217 - DNA, 3994 bp, Homo sapiens
gtggacggttggcgagggagtgtgtgtgtgtgtgtgtgtgtgtgtgtgtgtgtgtatccaagtgaccagaaggacgcctggaagaaaccaatgcttgcgggttgctgcaactacagggagcaagtcacctgtgcggggccgagacccccagagtctcgcgctgggaaaagttgtgcggggaggggaggacgtcggctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 1218 - DNA, 980 bp, Homo sapiens
gttggcggcgcggcccgggcgcttcaggtagcctctcggctctctctgctccgctccgcgcccagaggattgctcctgtgggtcacttgaggcaggctccaccttccccaggaggagtggcagagtccagccagcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgat

SEQ ID NO: 1219 - DNA, 2753 bp, Homo sapiens
attcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctg

SEQ ID NO: 1220 - DNA, 3156 bp, Homo sapiens
atagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttgg

SEQ ID NO: 1221 - DNA, 576 bp, Homo sapiens
cacagagaggaggacatcagcatggagagactgcagatcagtcccagcaaacctgtggaggccagttaaatgcctggagctcatcccctgccattcaaacggggtcttgctctgttgcctggctggagtgcagtggtgctaacatgactcactgcacccttgacctcctggactcaagtgatcctcccacctcagcctcccaagtagctgggactccaagtgggtgccactacagccactgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccct

SEQ ID NO: 1222 - DNA, 2143 bp, Homo sapiens
cggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 1223 - DNA, 2366 bp, Homo sapiens
ctggagggaggggcgtggatacagcgggaaaggagagacccctagcggggtggacaagaagggaggaactccacagaactgcttaatccggctccatccccatcagcgggctttctcagcgcctgcacccctctctatcccatctcgaagcctccagttaatccagagtgagacgcaggaccgccgggaggcgagcggggatgctgaagctagggcaggctaaagccccgcggccaaagggcaggcttgtgcgccctccgccccctctccgccccctctccgcccctccgcgcccaggacctaattgtttgcaaaagcaaacacggaaaagccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctgg

SEQ ID NO: 1224 - DNA, 3040 bp, Homo sapiens
gggccccaggtgggggtcgggggcgcctgcgcgggttgcctccggcagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaa

SEQ ID NO: 1225 - DNA, 1605 bp, Homo sapiens
gcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaa

SEQ ID NO: 1226 - DNA, 3121 bp, Homo sapiens
tcacgcagcgctctcgcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaa

SEQ ID NO: 1227 - DNA, 3438 bp, Homo sapiens
tcacgcagcgctctcgcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaa

SEQ ID NO: 1228 - DNA, 1181 bp, Homo sapiens
cgcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaaggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttag

SEQ ID NO: 1229 - DNA, 12503 bp, Homo sapiens
gcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaagtaccaccagcttcaggacgagtatttcaccagcgccgttgtcctcaccctcatcctggctgccttatttggccttgtctaccttctaatattcccacagagtgtggtcgtcctgctcctgctagtattctgcatctgcttcctggtggcctgtgtcctgtacctgcacatcacccgggtccagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacagccctgcccaccctgccctgcgagtctacacaccatgccctgctctgctgcctggtgggcaccctcccgctagccatatttttccgggtgtcctccttgccaaaaatgatcctgctctccgggctcaccacgtcctacatcctcgttctggagctcagcggatacaccaggactgggggtggtgccgtctccgggcgcagctacgagccgattgtggccatcctgctcttctcctgtgcgctggccctgcatgccaggcaggtggacatcaggctgaggctggactacctctgggccgcacaggcagaggaggagcgagaggacatggagaaggtgaagctggacaacaggcgcatcctcttcaacctcctgccggcccacgtcgcccagcacttcctcatgtccaaccctcggaacatggacctctactaccagtcctactcccaggtgggcgtcatgtttgcctccatccccaacttcaatgacttctacatcgagctggacggcaacaacatgggggtggagtgtctgcggcttctcaacgagatcatcgccgactttgacgagctcatggaaaaagacttttacaaggacatagagaagatcaagaccatcgggagcacctacatggccgctgtggggctagcgcccacctcggggaccaaggctaagaagtccatctcctcccacctgagcacgctggcggactttgccattgagatgtttgacgttctggatgaaatcaactaccagtcttacaacgactttgtcctccgagttggcatcaatgttggccctgtggtggctggagtgattggcgctcgcaggccccagtacgacatctggggaaacacagtcaacgtggccagtcggatggatagcacaggggtccagggcagaatccaggtgactgaggaagtccaccggctgctgagaaggtgcccctaccactttgtgtgccgaggcaaagtcagtgtcaagggcaaaggcgagatgttgacatactttctagaaggcaggactgatggaaacggctcccaaatcaggtccctgggcttggatcggaaaatgtgtccatttgggagagctggccttcagggcagacgtccccccgtgtgccccatgcctggcgtctcagtcagggctgggctccctccacactccccaggccagtacctgccctctgcagcagctgggaaggaggcttagtggagcccacgtgggcctctggggtgcacatggggtgggaatgctccgggggtgacacaggccacggtggctccagccaggaccagccagaccagcagagcagggagccacttgccagggtggaggaggagcattgtccaggcatggcctgtggcccgagggccaaccaccgagcaggcacagcacagcagtgactcggtgaggggaggacacccgactgtgcacacttccaggcctccctggagaggtgtccactccatccttccctccgtggcgtagggagcactgtttctttccagcaagcctgttcaggtttggccaggtcggcatcaatgtaaggaccttcagagcatcccagggttacagcaagagccactgaggtgtggctggcagagcaactgaggagctctgcgagagtgtgccctctgagacagccctgtccgccccgcccaggtgggacctgacatacaggcggctccagccctgggcagcggcttcaagagccagagtgggaagtcaggcctctctgggaaggtcacaaggcctggggttgttcacaccacaggcacaatacagagctgtccactcttgaactggaccgtctggggagaattgagaagctgcctctcactgcatggatagtggtggctgctggctttcaagcgtggttttttgctaagagccagaggcaggtcttctggagttctcaggggggccctgtgaccccctctccacaaccatggccagcatcggcttcttgctgcacctgtgcattctccacccctccgccaatggcttccagctcctaaaacacctggacattccccatcctgcaccggcactgtgtttgttcagagaaaacgaagggtgtcatttcttcttttccctgtggcatcgtggatcctttacatttagcaacaacagtgtgaggctccacttctgttgaatatgagcggctgtcacacccatgagcaagtttccttgatggaagatgctgtttctccggcagaaccaaccctccaggacgaagtttcagaattggctgatggtcgtgagtgcaggtgtccctgttgtaatttgcagggaaattgactgcaggtgatagtgttgacgtctgacgtctgacaacctcctatgtgcatgtctaaatagtcacaatgaagatgaaaataaggatgatggggacggggtccaggagggccactgggaaggcactatccagaaatagtggacagaggtctggcatgtggaaaccttggatctcggtcacagggaggaaggcagctagaaatgggagggaagcttctgggtaggcaccatagtaggggaatgtctaaagacccactgctctgagatgtggtcagagaggtttctgtggactgcagatgaggcctgagccctgcctatgctcaaagccagcagggttgggggtccgcctcctcactgctcctcaacagctgtaaccctttcctgagggccccgacttttcagaataggagcagagagaagcccagacttccttccctggagtgtagacctgtgtgtgggacctgctccaggctgatccctgtccgcacaggtgggtgatgtccttggctgctgccgtcagaggcagccccctgcacagggaggggctgatcctgcctcagctgtgtggccatgtgggggcagcaggggcctgggccatagctgggggaggccagaccctgagggctttgcagggcggccagtgcagtgatgcctggcgcttccagctgagacaggagtccggacagaggtgggcagggtggatggcttcgggcagggaaggcgggtagaggctgcatgtgggggcccctgtctgcctgtccttagggtgtggattaggctctggcttctgtgatggtgcaagaggcaggatggtctccagacaccttcttgcagagtgattttgaccaatgcctttccagcaccttcccctggttatgacagggagctcccaggccaggccacatgaccccacaggtaggctgaccccatggacccactggagactttgagggcagagctcgggcacctttcatcttccttgggtggtcctcatgtcgctgtccgctcatgttcctggtgttctggcatcaccttgtgccggtgggggctgggctcccgtgaggtcctagggcagaaggaggtgcttgcagggcctctcgctgctactgggacatccacaggacctaatgtttatgtggaatctccaggctgccatcgagggctcctgagctcatcctgaggacccagggtccatctgagctggctgtgggctgagatcctggctggggccctgctgtcaacctctcctccaggccctgccttgtccctgctcctgtgctttcctctcttcaggacaaatggtttgtccttatggtcccctttccactaggattttctcatcctcatctgtctatcccagccggatttaaagcagtcacttcagacaggagccacagggagcctgtgagggagtagtgcggtggtggtgagtgtggctgccctggctcccccagctcaccgtggtgctgtccttgacccacgagctgttgagaagggtgcagagcccctggcacagccaaccctgttgcccccagtgccgctgcccagcttcggccatccaggtggtgggtagacagaggagtgaaccccaaaggtgtccatgccccagttctaagccctgtggccaggtgctgtcacacagcaaaggggactttgcaggtggaattagggttagggatctaaggatgggaggggaacttggtttatctgggtgggctcagtgaccccttggaatggctgagggaggcaggagagcctggaaagattcgaagtgtcacagagatggtgccgtcattgctggcttaaagacaaggggccaggagccaacaccagaggccactccacaaccccagcgccagtcagcaaggaagccgggtgtcgctcacacaaccagaaggagctgagtttggcaacaacccaagtgagcctgaagcagattcgccccagagcctccaggcgtgagtggagcccagtccagcgacaccttggtttggcctgtgagactgagaagagagccagccacgccatgctgtgcctggggtccacagagccgggaggtcacacatgtacatcctggaagctgcccaaggtgtggccacttgtagggcagtgagaggaagccgtcgcggggaccatgctgccttctctgggctcacgactgttctggaaaggaccccatggcagacttggcaaggtctccacttcaggggcaaacatctccatcatcagcaactccaaaccccagccacttcctgggagttcaggaactgtgtttagccataatgtcccttggggtttggtgaaaaacaacttcctttttatttgtgggaaaactgtattatattgccttatttatttttaatcatgtacaatattcatgtacaaatgttagagccattcgggtaggattctctctaaattatttattgaagaggctttgtaaatagtgcaccagtgacaggtgctgcctgtttactcgtaccaaaaatgaagacaagccccacacccacctcagcccttgcttggccatgctgtggccctttggaaatgaccctgtgtgctcccctcgcgacccttgcatgcctttcatgcctgatgccgtagagtagaacacagccccggaatgcttccagttgcttgcaagggaccatgccggcccgggtggtccatgcctgcggggtgtctgtatcctgcaggaggacgcccctacagacccagcaacccaagttgccagcccgtgtttctcagactttaaagccaccagggcttctggaacacctgtcatagaagcaataactctaactctatactgtagagatgagtctggtccgaagcagattagtaatttagagataagccatgcatacaagtttgccccattctctggcttggggtggtgggaggcggggagctgccactcccaaagcctccaccccttcctgaagacccagctatgaaaccgcagttcctgtgggttgggctgcccaggctggtcagagctcagcaccccaggtctggtgagcagacagagccggcgttaaaccccgatcaggtcattgtcaccacacccttgcttggatgaggaaggaaggaggcaaaggcacccactccatccaagatccgttccaattgatgagcctcagtactggcctcacactgaccaacggtggtatgctgcagtttgttggtttggtgcagagtctaaaggataacatatcaaggcttacctgtgataggccattttaaggaaatggtggcactctgaaggctgtccccattcaccttccacaatgctggtaccatcctggtagaagagccctctgaacaggacacctgttcaggcctgggggccccatgctaggcttgcctgggtgtgagaaggtcgaactgggtggcttaggccttcaaattgagcttgggggtgtccaagagaggggtcttattcgaggaactcacataccccaaataaccatcagtgcacaaatcattccatgctctttggcaccaggcaggagatgctgcaggcaggtgtccgtagttggcaaaaatgggcagtaggggaaatggagttgcttcaacctttctcagtcccggccctcactgcacccaccaagtcaagcagagctgggtgggctgagaccagcatcccagctggactgagcctggggggaggggctggagccaaggagcccccctgggtgggggcatcaggagcaggggcagggcctgaggactgctccccctgcatggagggcaggccaggatggagcccagggtagactttgaggaaggctcagtgggctcagcagaaggaaggctcttctcatagttgtggtttttcacagatggatttgggtgatctgagtgtggtcaggccctgccgttggggaatgaatgccacacggggtttgtctgtaagctgcagtgtctgtgattctgtgtgaactgacagcagggagctgaaggacaggccccggccttgggagaggacacgggcatgggctgctggatgcagggctcccagggctgtgaaggcagaggggtctctggaggcagacagggtgggctgggggccagcagcagggggcagagccccagccagggcagctgcttcctgcacatagacattcctcctgcgcagggccaagtgcccatgagcacagccccagacagacacggtggggagcttggagccctccgctcacctagaggagccctgggacacgcactggaaagtattctaggggcttcctgccttatccttctgtttgttcatacacttagtgaaagcagatcctgtactaggatgtgaggatatctgtcacctgcgtggtccattccataaacaccagattccatttcagttgccacacattttggggctagacttccctaaacaacatgccattgtgaaataatgcatatatttgtatttttaaatttccctgaaaatttaatctattctgttccatatgaagtctgtttcactaccttaaaaaatagatactccactagaggctgtgcttaattcaaatccatgtgtgtgcctgcattacatgtgtgaacacgtgtttctgtcgtgtgtgtcatgcacatctgtgtgttgcatagcataagccaaatgaaaatcatttgttcatgggattcatatgaggaacaaaattaaatttgaatacagtcagataactgccacgcagggcatttggggaaccatccccgaatgccctgatgtgatttccctcagaaaatccttgttattagaggagaaggtctgggcaggggcagcagcatctcagacatcaagtcaactttatcatctactacatcagcactgaagtccaggggcattgaggcactaactaggttccattttctttggtttggttacttattttttctttttgggttctcggtgtgcagaggctgtagagagagcctcagggcggtgaccgctgcaggaattcggccctccagctcccctccagttaccaggagccgatttggaggccaggccttcccagctgagtgtctgtcagcttcattctctctcagctgtgcagtggaagagcaacaacagacaggtgaccttcttgggttgtgcttcacaatggactgggaaaaacatctttgaaatcaggaaatcaggccgggcgcagtggctcatgcctgtaagcccagcactttgggaggcggaggcgggtggatccattgaggtcaggagctcaagaccagcctggtcaacatggtgaaaccccgtctctactaaaaatacaaaaaaaaaattagctgggcgtgttggcgggagcctgtagtcccagctacacgggaggctaaggtgggagaattgcttgaacccgggaggcggaggttgcagtgagctgagattgcaccattgcactccagcctgggcgacagagcaagactctctcaaaaaaaaaaaaaaaagaaagaaagaaatcagaaaatcgaccacagtggtagccacctggcctaatgctgtgtttttgtacctgacaggggtcactcattttaggcacaactccttcattctttgtgaaattagtgagtttccttctacccgtcaccagattcaatatgttctattaatacaccgataaccacaggggaagggcacttgtcgctctcccacctggttaccacagtctccatgggtcttttgccgtgaccacaaataaaggaaacactcatcactagtatctaagtcgggctttacagtaactatgcaccttctgtgtgcttcacctcactctctacttcaaacagcccatggagggaggtattattatactccttatgttgacagtgaagaatctgaggcccagagaggttggggacttgagtaaagtcacacagccctgagaggcaggaccagggttccattcctgctctatccagttccaagcccttgtgttttccattatgtttagtgcctctttgctaacagcaacatctgcaagatttgtgttggttttgatggagaactctagctcatccacatgctagtgcccaagtggtggaggggccacctcagcaggtgggttctgaatgcagccaaggctgtccccgcaatgggtgagactcgctccaactgcccgccctcagagcaggtgcctaagtcctccctggcactggcaggccttacctcacattgctaaattaaagcaatgcaattcctcttgggtaagaggaattcctccttctttactaactgatccccagcaaggaaataaaatgttaggctttaaaaatccctactttgtcatatcagactatattctaaaactatatttgagcgaaacctgtcattgcgtctaatttcaaatatacagaatctccttaagagctgttgccttatttttttgtaaagcctctctgacatcaaatggggagaaatggtggcacctccagacaccctgaaactacacaccatttcttccctgctcagcttctgctcaggagttctgtgagctatgggaaggccattggttgtatttgctacttttactttcatcttcctctgctgtagagccatttaatgttattgtcatatgctgctggtgaggtaaaggtgggtccgggtgccttcccaggggttagaggatgttcaaagggccgatttcagcaggagttcagagggcttatgatggatggtgagagatttgacaaccaccagagcacatgtgctctgaccctctcctgggcattggttcctgctggtaccgggcggttcagaccttcaaataggttgctttcaaaagagctttcaggcacttattgagaattaatgtttaaacagacataatagcctagatgaactcccaagagatctattaaatcttgtgggctgaataaatatctcgtgcaggactgtgcaacagtagcccagagcatcctgcctgtgggcatccacctcccaggtgagggcagtgggaagctggcccgacggcagccagaacttgtttctcacctcccaccagcaaccccccacccaactctgggccccaggcacacgaagcacaagtctcaggggaccattcccacattgggggatcctgagggagcccatcaccgcctcttgcatacaactgtccactaggaggcacgcccagtgtgggagagatgtatggtcttgccttccacctgtaaaaactgcacatatgcaagccatttgcactctggaactgcatgccgtgaaaactcctaatggtgtggaacttagtttgaatttgaaatcacgccgcatgcacaaagggacaggcccaggcccgacctcaggtcatccgcccgctggctgcagagcatccctgggagccaaggcgaggcccgtggagcctgagctttgtgtagctcgagctttgtgtagctcgtgcacttattatgcaccacctcccttcagtcaccactcctcttcctccgccatcctcatttatactgattgcacaccccccgctcaaacaacaatgtccttattatgatgaccatctcgtagtggtacattccattcctatttaaggtaagcccaaagcccacttttggattttctcgactgtccgagaaaagttgtgtaagcgcctgcgttcttctgggtttggctagatagggttgtgtccctctatggaatggagagtgatgtgggcaagggtgtcattttctcgcacaatacaactcactgaggatgcttctgtagaagtgagaaacacgatgagtacattcagaattacaataactcactctcactgggtaacttctcatgatagatttgtatgatcaatacgggtctatttttatgtcaactgaacactgtagggtaccttccagtctttttcaagattgttaaattgagacaagtaattgaataatttgtcctatttttattttaaaaaaagtgaatggactgaaatgttaaatgtgaatgtacatttcttaattgcaacttttctactgagtgtttgcactatactttctggaatcttatttaacaaaaataaagggaaaaaattgcttgactaaa

SEQ ID NO: 1230 - DNA, 12497 bp, Homo sapiens
ccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaagtaccaccagcttcaggacgagtatttcaccagcgccgttgtcctcaccctcatcctggctgccttatttggccttgtctaccttctaatattcccacagagtgtggtcgtcctgctcctgctagtattctgcatctgcttcctggtggcctgtgtcctgtacctgcacatcacccgggtccagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacagccctgcccaccctgccctgcgagtctacacaccatgccctgctctgctgcctggtgggcaccctcccgctagccatatttttccgggtgtcctccttgccaaaaatgatcctgctctccgggctcaccacgtcctacatcctcgttctggagctcagcggatacaccaggactgggggtggtgccgtctccgggcgcagctacgagccgattgtggccatcctgctcttctcctgtgcgctggccctgcatgccaggcaggtggacatcaggctgaggctggactacctctgggccgcacaggcagaggaggagcgagaggacatggagaaggtgaagctggacaacaggcgcatcctcttcaacctcctgccggcccacgtcgcccagcacttcctcatgtccaaccctcggaacatggacctctactaccagtcctactcccaggtgggcgtcatgtttgcctccatccccaacttcaatgacttctacatcgagctggacggcaacaacatgggggtggagtgtctgcggcttctcaacgagatcatcgccgactttgacgagctcatggaaaaagacttttacaaggacatagagaagatcaagaccatcgggagcacctacatggccgctgtggggctagcgcccacctcggggaccaaggctaagaagtccatctcctcccacctgagcacgctggcggactttgccattgagatgtttgacgttctggatgaaatcaactaccagtcttacaacgactttgtcctccgagttggcatcaatgttggccctgtggtggctggagtgattggcgctcgcaggccccagtacgacatctggggaaacacagtcaacgtggccagtcggatggatagcacaggggtccagggcagaatccaggtgactgaggaagtccaccggctgctgagaaggtgccccccactttgtgtgccgaggcaaagtcagtgtcaagggcaaaggcgagatgttgacatactttctagaaggcaggactgatggaaacggctcccaaatcaggtccctgggcttggatcggaaaatgtgtccatttgggagagctggccttcagggcagacgtccccccgtgtgccccatgcctggcgtctcagtcagggctgggctccctccacactccccaggccagtacctgccctctgcagcagctgggaaggaggcttagtggagcccacgtgggcctctggggtgcacatggggtgggaatgctccgggggtgacacaggccacggtggctccagccaggaccagccagaccagcagagcagggagccacttgccagggtggaggaggagcattgtccaggcatggcctgtggcccgagggccaaccaccgagcaggcacagcacagcagtgactcggtgaggggaggacacccgactgtgcacacttccaggcctccctggagaggtgtccactccatccttccctccgtggcgtagggagcactgtttctttccagcaagcctgttcaggtttggccaggtcggcatcaatgtaaggaccttcagagcatcccagggttacagcaagagccactgaggtgtggctggcagagcaactgaggagctctgcgagagtgtgccctctgagacagccctgtccgccccgcccaggtgggacctgacatacaggcggctccagccctgggcagcggcttcaagagccagagtgggaagtcaggcctctctgggaaggtcacaaggcctggggttgttcacaccacaggcacaatacagagctgtccactcttgaactggaccgtctggggagaattgagaagctgcctctcactgcatggatagtggtggctgctggctttcaagcgtggttttttgctaagagccagaggcaggtcttctggagttctcaggggggccctgtgaccccctctccacaaccatggccagcatcggcttcttgctgcacctgtgcattctccacccctccgccaatggcttccagctcctaaaacacctggacattccccatcctgcaccggcactgtgtttgttcagagaaaacgaagggtgtcatttcttcttttccctgtggcatcgtggatcctttacatttagcaacaacagtgtgaggctccacttctgttgaatatgagcggctgtcacacccatgagcaagtttccttgatggaagatgctgtttctccggcagaaccaaccctccaggacgaagtttcagaattggctgatggtcgtgagtgcaggtgtccctgttgtaatttgcagggaaattgactgcaggtgatagtgttgacgtctgacgtctgacaacctcctatgtgcatgtctaaatagtcacaatgaagatgaaaataaggatgatggggacggggtccaggagggccactgggaaggcactatccagaaatagtggacagaggtctggcatgtggaaaccttggatctcggtcacagggaggaaggcagctagaaatgggagggaagcttctgggtaggcaccatagtaggggaatgtctaaagacccactgctctgagatgtggtcagagaggtttctgtggactgcagatgaggcctgagccctgcctatgctcaaagccagcagggttgggggtccgcctcctcactgctcctcaacagctgtaaccctttcctgagggccccgacttttcagaataggagcagagagaagcccagacttccttccctggagtgtagacctgtgtgtgggacctgctccaggctgatccctgtccgcacaggtgggtgatgtccttggctgctgccgtcagaggcagccccctgcacagggaggggctgatcctgcctcagctgtgtggccatgtgggggcagcaggggcctgggccatagctgggggaggccagaccctgagggctttgcagggcggccagtgcagtgatgcctggcgcttccagctgagacaggagtccggacagaggtgggcagggtggatggcttcgggcagggaaggcgggtagaggctgcatgtgggggcccctgtctgcctgtccttagggtgtggattaggctctggcttctgtgatggtgcaagaggcaggatggtctccagacaccttcttgcagagtgattttgaccaatgcctttccagcaccttcccctggttatgacagggagctcccaggccaggccacatgaccccacaggtaggctgaccccatggacccactggagactttgagggcagagctcgggcacctttcatcttccttgggtggtcctcatgtcgctgtccgctcatgttcctggtgttctggcatcaccttgtgccggtgggggctgggctcccgtgaggtcctagggcagaaggaggtgcttgcagggcctctcgctgctactgggacatccacaggacctaatgtttatgtggaatctccaggctgccatcgagggctcctgagctcatcctgaggacccagggtccatctgagctggctgtgggctgagatcctggctggggccctgctgtcaacctctcctccaggccctgccttgtccctgctcctgtgctttcctctcttcaggacaaatggtttgtccttatggtcccctttccactaggattttctcatcctcatctgtctatcccagccggatttaaagcagtcacttcagacaggagccacagggagcctgtgagggagtagtgcggtggtggtgagtgtggctgccctggctcccccagctcaccgtggtgctgtccttgacccacgagctgttgagaagggtgcagagcccctggcacagccaaccctgttgcccccagtgccgctgcccagcttcggccatccaggtggtgggtagacagaggagtgaaccccaaaggtgtccatgccccagttctaagccctgtggccaggtgctgtcacacagcaaaggggactttgcaggtggaattagggttagggatctaaggatgggaggggaacttggtttatctgggtgggctcagtgaccccttggaatggctgagggaggcaggagagcctggaaagattcgaagtgtcacagagatggtgccgtcattgctggcttaaagacaaggggccaggagccaacaccagaggccactccacaaccccagcgccagtcagcaaggaagccgggtgtcgctcacacaaccagaaggagctgagtttggcaacaacccaagtgagcctgaagcagattcgccccagagcctccaggcgtgagtggagcccagtccagcgacaccttggtttggcctgtgagactgagaagagagccagccacgccatgctgtgcctggggtccacagagccgggaggtcacacatgtacatcctggaagctgcccaaggtgtggccacttgtagggcagtgagaggaagccgtcgcggggaccatgctgccttctctgggctcacgactgttctggaaaggaccccatggcagacttggcaaggtctccacttcaggggcaaacatctccatcatcagcaactccaaaccccagccacttcctgggagttcaggaactgtgtttagccataatgtcccttggggtttggtgaaaaacaacttcctttttatttgtgggaaaactgtattatattgccttatttatttttaatcatgtacaatattcatgtacaaatgttagagccattcgggtaggattctctctaaattatttattgaagaggctttgtaaatagtgcaccagtgacaggtgctgcctgtttactcgtaccaaaaatgaagacaagccccacacccacctcagcccttgcttggccatgctgtggccctttggaaatgaccctgtgtgctcccctcgcgacccttgcatgcctttcatgcctgatgccgtagagtagaacacagccccggaatgcttccagttgcttgcaagggaccatgccggcccgggtggtccatgcctgcggggtgtctgtatcctgcaggaggacgcccctacagacccagcaacccaagttgccagcccgtgtttctcagactttaaagccaccagggcttctggaacacctgtcatagaagcaataactctaactctatactgtagagatgagtctggtccgaagcagattagtaatttagagataagccatgcatacaagtttgccccattctctggcttggggtggtgggaggcggggagctgccactcccaaagcctccaccccttcctgaagacccagctatgaaaccgcagttcctgtgggttgggctgcccaggctggtcagagctcagcaccccaggtctggtgagcagacagagccggcgttaaaccccgatcaggtcattgtcaccacacccttgcttggatgaggaaggaaggaggcaaaggcacccactccatccaagatccgttccaattgatgagcctcagtactggcctcacactgaccaacggtggtatgctgcagtttgttggtttggtgcagagtctaaaggataacatatcaaggcttacctgtgataggccattttaaggaaatggtggcactctgaaggctgtccccattcaccttccacaatgctggtaccatcctggtagaagagccctctgaacaggacacctgttcaggcctgggggccccatgctaggcttgcctgggtgtgagaaggtcgaactgggtggcttaggccttcaaattgagcttgggggtgtccaagagaggggtcttattcgaggaactcacataccccaaataaccatcagtgcacaaatcattccatgctctttggcaccaggcaggagatgctgcaggcaggtgtccgtagttggcaaaaatgggcagtaggggaaatggagttgcttcaacctttctcagtcccggccctcactgcacccaccaagtcaagcagagctgggtgggctgagaccagcatcccagctggactgagcctggggggaggggctggagccaaggagcccccctgggtgggggcatcaggagcaggggcagggcctgaggactgctccccctgcatggagggcaggccaggatggagcccagggtagactttgaggaaggctcagtgggctcagcagaaggaaggctcttctcatagttgtggtttttcacagatggatttgggtgatctgagtgtggtcaggccctgccgttggggaatgaatgccacacggggtttgtctgtaagctgcagtgtctgtgattctgtgtgaactgacagcagggagctgaaggacaggccccggccttgggagaggacacgggcatgggctgctggatgcagggctcccagggctgtgaaggcagaggggtctctggaggcagacagggtgggctgggggccagcagcagggggcagagccccagccagggcagctgcttcctgcacatagacattcctcctgcgcagggccaagtgcccatgagcacagccccagacagacacggtggggagcttggagccctccgctcacctagaggagccctgggacacgcactggaaagtattctaggggcttcctgccttatccttctgtttgttcatacacttagtgaaagcagatcctgtactaggatgtgaggatatctgtcacctgcgtggtccattccataaacaccagattccatttcagttgccacacattttggggctagacttccctaaacaacatgccattgtgaaataatgcatatatttgtatttttaaatttccctgaaaatttaatctattctgttccatatgaagtctgtttcactaccttaaaaaatagatactccactagaggctgtgcttaattcaaatccatgtgtgtgcctgcattacatgtgtgaacacgtgtttctgtcgtgtgtgtcatgcacatctgtgtgttgcatagcataagccaaatgaaaatcatttgttcatgggattcatatgaggaacaaaattaaatttgaatacagtcagataactgccacgcagggcatttggggaaccatccccgaatgccctgatgtgatttccctcagaaaatccttgttattagaggagaaggtctgggcaggggcagcagcatctcagacatcaagtcaactttatcatctactacatcagcactgaagtccaggggcattgaggcactaactaggttccattttctttggtttggttacttattttttctttttgggttctcggtgtgcagaggctgtagagagagcctcagggcggtgaccgctgcaggaattcggccctccagctcccctccagttaccaggagccgatttggaggccaggccttcccagctgagtgtctgtcagcttcattctctctcagctgtgcagtggaagagcaacaacagacaggtgaccttcttgggttgtgcttcacaatggactgggaaaaacatctttgaaatcaggaaatcaggccgggcgcagtggctcatgcctgtaagcccagcactttgggaggcggaggcgggtggatccattgaggtcaggagctcaagaccagcctggtcaacatggtgaaaccccgtctctactaaaaatacaaaaaaaaaattagctgggcgtgttggcgggagcctgtagtcccagctacacgggaggctaaggtgggagaattgcttgaacccgggaggcggaggttgcagtgagctgagattgcaccattgcactccagcctgggcgacagagcaagactctctcaaaaaaaaaaaaaaaagaaagaaagaaatcagaaaatcgaccacagtggtagccacctggcctaatgctgtgtttttgtacctgacaggggtcactcattttaggcacaactccttcattctttgtgaaattagtgagtttccttctacccgtcaccagattcaatatgttctattaatacaccgataaccacaggggaagggcacttgtcgctctcccacctggttaccacagtctccatgggtcttttgccgtgaccacaaataaaggaaacactcatcactagtatctaagtcgggctttacagtaactatgcaccttctgtgtgcttcacctcactctctacttcaaacagcccatggagggaggtattattatactccttatgttgacagtgaagaatctgaggcccagagaggttggggacttgagtaaagtcacacagccctgagaggcaggaccagggttccattcctgctctatccagttccaagcccttgtgttttccattatgtttagtgcctctttgctaacagcaacatctgcaagatttgtgttggttttgatggagaactctagctcatccacatgctagtgcccaagtggtggaggggccacctcagcaggtgggttctgaatgcagccaaggctgtccccgcaatgggtgagactcgctccaactgcccgccctcagagcaggtgcctaagtcctccctggcactggcaggccttacctcacattgctaaattaaagcaatgcaattcctcttgggtaagaggaattcctccttctttactaactgatccccagcaaggaaataaaatgttaggctttaaaaatccctactttgtcatatcagactatattctaaaactatatttgagcgaaacctgtcattgcgtctaatttcaaatatacagaatctccttaagagctgttgccttatttttttgtaaagcctctctgacatcaaatggggagaaatggtggcacctccagacaccctgaaactacacaccatttcttccctgctcagcttctgctcaggagttctgtgagctatgggaaggccattggttgtatttgctacttttactttcatcttcctctgctgtagagccatttaatgttattgtcatatgctgctggtgaggtaaaggtgggtccgggtgccttcccaggggttagaggatgttcaaagggccgatttcagcaggagttcagagggcttatgatggatggtgagagatttgacaaccaccagagcacatgtgctctgaccctctcctgggcattggttcctgctggtaccgggcggttcagaccttcaaataggttgctttcaaaagagctttcaggcacttattgagaattaatgtttaaacagacataatagcctagatgaactcccaagagatctattaaatcttgtgggctgaataaatatctcgtgcaggactgtgcaacagtagcccagagcatcctgcctgtgggcatccacctcccaggtgagggcagtgggaagctggcccgacggcagccagaacttgtttctcacctcccaccagcaaccccccacccaactctgggccccaggcacacgaagcacaagtctcaggggaccattcccacattgggggatcctgagggagcccatcaccgcctcttgcatacaactgtccactaggaggcacgcccagtgtgggagagatgtatggtcttgccttccacctgtaaaaactgcacatatgcaagccatttgcactctggaactgcatgccgtgaaaactcctaatggtgtggaacttagtttgaatttgaaatcacgccgcatgcacaaagggacaggcccaggcccgacctcaggtcatccgcccgctggctgcagagcatccctgggagccaaggcgaggcccgtggagcctgagctttgtgtagctcgagctttgtgtagctcgtgcacttattatgcaccacctcccttcagtcaccactcctcttcctccgccatcctcatttatactgattgcacaccccccgctcaaacaacaatgtccttattatgatgaccatctcgtagtggtacattccattcctatttaaggtaagcccaaagcccacttttggattttctcgactgtccgagaaaagttgtgtaagcgcctgcgttcttctgggtttggctagatagggttgtgtccctctatggaatggagagtgatgtgggcaagggtgtcattttctcgcacaatacaactcactgaggatgcttctgtagaagtgagaaacacgatgagtacattcagaattacaataactcactctcactgggtaacttctcatgatagatttgtatgatcaatacgggtctatttttatgtcaactgaacactgtagggtaccttccagtctttttcaagattgttaaattgagacaagtaattgaataatttgtcctatttttattttaaaaaaagtgaatggactgaaatgttaaatgtgaatgtacatttcttaattgcaacttttctactgagtgtttgcactatactttctggaatcttatttaacaaaaataaagggaaaaaattgcttgactaaa

SEQ ID NO: 1231 - DNA, 6575 bp, Homo sapiens
aggcggcgcgggggtgggacgcgggcggccgcggcgagcggcgctgcccgggccgggcgcgcacggcgggcgccctgtgagcggccccgatgtggcaggaggcgatgcggcgccgccgctacctgcgggaccgctccgaggaggcggcgggcggcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggaagttgaagaccatgtggcgtttctaataacagttccaactgccctggcgattttctttgcgatatttatcctggtctgcatcgagtctgtgtttaagaagctgctgcgcctcttctcgttggtgatatggatatgccttgttgccatgggatacctgttcatgtgttttggaggcaccgtctctccctgggaccaggtatcgttcttcctcttcatcatcttcgtggtgtacaccatgctgcccttcaacatgcgagacgccatcattgccagcgtcctcacctcctcctcccacaccatcgtgcttagcgtctgcctgtctgcaacaccgggaggcaaggagcacctggtctggcagatcctggccaatgtgatcattttcatctgtgggaacctggcgggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtccgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttgatttacagtgcctgtatcttttattttcctgtcttctttctcctgtggtttgctccagaattaaggtttgttttccatccattctcccttttgacacagttgtttcagaaagagctctccagaagccaatattgagatgtaattcagattaggacacagtgtgtgacgcagataactggttactcagctccctggaaagcaggcaagcatgttgaatgtatctagtggtctgattttaatttgggcatctctagagaacgctttcagggaaaaatactttaatagtaaaaagattctctgcgagcaacagtgccccctccgtccactacgctcctgtctccaagaatgttttgctagagctaacagacatagactgcaaaagaataatttggaatcagctatgcaaatcagtctcacaatagcgtgagctaactgagagaagtactaagacccacaaactgcctgttaagtctgagaaggctaaagaagacacacagccaacgttcatgcatttttaaagacagaaggccttgaagaatttgttcttgtaaatccaacacaagttgtttggtacttttaacataaagaaatcatactttgccaaatagtgaaaagtagagcaatcgtgtataagctaatgtttaaaagcaaaactgcaaattgtagcccagttggtcaaacttgttttctttttataactcatggcaggcatctgtaagaagtagagaacccagatgatctcttaggaagccttttattcgtgggaactcgaacttgaagcacaagttcctggtttgaatcctggctctgattttttactggctgtgtgactttgaacacatctcttagtccctcttaggagtactttccttattggcaacttatggactcgctagtgattaaacgaggcaatgactgtgagcgagcctggcaggtgccccgtggtacattcacagcacgggcacagctgctgtgccaggactgtgactcattcccagtaaaaggcacttatcgaagctgataaccgtccttcatcaccgaagtgtgagtagagcatgacttatttagtattctgcctcaatggggaattttttgatcctgtaatcacaactcagcattggccttaatatacctaaatctccaaaaacagtgattaaagcaagagaattattacaagggcttttctctttcctctaactcattcttcacggatgccgtagcgtttccgtgagctcaaactggccttggtgtaaaatgtgtaaggatgagcagcaggcgtgcctcgtgggttcttcctctgttacatcctgctacactcatccgcaggtcaccttagttcacctaccctgagtgaacacccccagctgggtggtccaccaagttctcataaacagagtccctcccattcccccacggggtgcaccgaacttgggtttgcgctaaaaagaactcaaaaggagaactgtgctctcccaaagccatatcaccagtcttaccaaacaataggcttttaaaagcattgagtcattgtcagaatccactatgggaagctctgtgtgtacctggtcccttctaggtgtggtcccataggagcagccttagcatcccctgtgaacttatcaaaaatgcaaattctcaggccccaacctgaaggaggaccctgaatttgagatccccggggctggggcccagcacaactgctgtttagtgaacaggttctccaggtgattctgatccctgatcaagcttcagacctccctccctccccagtgtttttgcaggtgaggaaacaggggcagagtaattcaggcacatgtgttcagagttccacagttgattagcagttgaggccaggctagaatggaaaactgcctgttccttgaatctgaaagagcattattcctggtcaaagctccttaaagttctgggcagctaaaagcatccctgtgagcaaaaatgccaggcagaaaactggcagtgcacctctcatcagcccaggtcccagtgccattggcttcaagaaaaaaaaaaaatctctccccaatgctctccttaacctttaagtcttacaggaagcctctcatagaaattgcctccagtccagtttcccaaaaaccccagtgttttacatatctgtttaggagtgtctaagttttgtcatcaatccaggatgttattcttccttcccaactcactgtgctcctaaaggcagcaaccattcatctttcctttgctctggatacaccgaatgaccaggtaacatcatcaggccgggtgcagtggctcctataatcccaatattttgggaggccgaggagagaggatcacttaagcccaggagtctgagaccagcctgggcaacatagcaagacccccatctctgcaaaaaaataagaaaattagcttggcatggtggcacgtgcctgtagtcccagctacatgggaggctgaggtgggaggatcacttgagcccaggaagtccagaacgtagtgagccttgattataccactgcactccagcctgggtgacagagcgagactctgtctcag

SEQ ID NO: 1232 - DNA, 5052 bp, Homo sapiens
ccccgatgtggcaggaggcgatgcggcgccgccgctacctgcgggaccgctccgaggaggcggcgggcggcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggaagttgaagaccatgtggcgtttctaataacagttccaactgccctggcgattttctttgcgatatttatcctggtctgcatcgagtctgtgtttaagaagctgctgcgcctcttctcgttggtgatatggatatgccttgttgccatgggatacctgttcatgtgttttggaggcaccgtctctccctgggaccaggtatcgttcttcctcttcatcatcttcgtggtgtacaccatgctgcccttcaacatgcgagacgccatcattgccagcgtcctcacctcctcctcccacaccatcgtgcttagcgtctgcctgtctgcaacaccgggaggcaaggagcacctggtctggcagatcctggccaatgtgatcattttcatctgtgggaacctggcgggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtccgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggagttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttgatttacagtgcctgtatcttttattttcctgtcttctttctcctgtggtttgctccagaattaaggtttgttttccatccattctcccttttgacacagttgtttcagaaagagctctccagaagccaatattgagatgtaattcagattaggacacagtgtgtgacgcagataactggttactcagctccctggaaagcaggcaagcatgttgaatgtatctagtggtctgattttaatttgggcatctctagagaacgctttcagggaaaaatactttaatagtaaaaagattctctgcgagcaacagtgccccctccgtccactacgctcctgtctccaagaatgttttgctagagctaacagacatagactgcaaaagaataatttggaatcagctatgcaaatcagtctcacaatagcgtgagctaactgagagaagtactaagacccacaaactgcctgttaagtctgagaaggctaaagaagacacacagccaacgttcatgcatttttaaagacagaaggccttgaagaatttgttcttgtaaatccaacacaagttgtttggtacttttaacataaagaaatcatactttgccaaatagtgaaaagtagagcaatcgtgtataagctaatgtttaaaagcaaaactgcaaattgtagcccagttggtcaaacttgttttctttttataactcatggcaggcatctgtaagaagtagagaacccagatgatctcttaggaagccttttattcgtgggaactcgaacttgaagcacaagttcctggtttgaatcctggctctgattttttactggctgtgtgactttgaacacatctcttagtccctcttaggagtactttccttattggcaacttatggactcgctagtgattaaacgaggcaatgactgtgagcgagcctggcaggtgccccgtggtacattcacagcacgggcacagctgctgtgccaggactgtgactcattcccagtaaaaggcacttatcgaagctgataaccgtccttcatcaccgaagtgtgagtagagcatgacttatttagtattctgcctcaatggggaattttttgatcctgtaatcacaactcagcattggccttaatatacctaaatctccaaaaacagtgattaaagcaagagaattattacaagggcttttctctttcctctaactcattcttcacggatgccgtagcgtttccgtgagct

SEQ ID NO: 1233 - DNA, 2970 bp, Homo sapiens
gaggagtttggtagaaatcccagaagagctgttgagaagaccagtggagccacacgtctagaggtcatggacctgcgctgggccagagatctgcatttgagagaagccagcagatcagtagcatttaccaccctgaggctgggcgcagtcaccacgggactcctgacattcagagagccaggagataaagagaagtcaggaaagggccttgggaagagatggcgcatccagcgagaggaaagccaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtccgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtg

SEQ ID NO: 1234 - DNA, 3532 bp, Homo sapiens
aggctcttagaaaccagaatatttggtgactcttattgttcttcttctctgcccgtaggtatcgttcttcctcttcatcatcttcgtggtgtacaccatgctgcccttcaacatgcgagacgccatcattgccagcgtcctcacctcctcctcccacaccatcgtgcttagcgtctgcctgtctgcaacaccgggaggcaaggagcacctggtctggcagatcctggccaatgtgatcattttcatctgtgggaacctggcgggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtccgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttg

SEQ ID NO: 1235 - DNA, 5050 bp, Homo sapiens
cgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacaggtaaacgcaggggcagggccaggcttccgggggggaagacagcgccccgagcgtgggaagggggccggatcggagcccgagcctccaagggtttggtggaaaaaggaagtaaacagaaggaaggctcaggaatcccccacgatggtcctgatttctttccggcacattttatttacagcttctaaggactgggcctggagggaatttaggtgaggaagtcggggactgagaaagaagagatgacagagagaaaccggttaccagggatggaaaggcggctaggcccttccacaagccagggacaggaaattgagtgtctggcgtggacaggactaagtgtgcctgcggtgggcggtggtgtgagccgggggtggcagggaaggccctgggttgggaggctcttgcagcagagatccttttatgagggttagggcgggtcatggggaaaccgcaaggtaggagggaagaggtgcttctactcagcaatgcccttttcagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctgtgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 1236 - DNA, 4325 bp, Homo sapiens
cttttcagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctgtgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttg

SEQ ID NO: 1237 - DNA, 572 bp, Homo sapiens
atttacagcttctaaggactgggcctggagggaatttagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctgga

SEQ ID NO: 1238 - DNA, 3415 bp, Homo sapiens
agagcgcagcggcgagcgtgactccgccatcaggtccccggctccctccccggacctagcccactccgctgcgccagcgccgcgggcaccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccattgatgtctg

SEQ ID NO: 1239 - DNA, 2148 bp, Homo sapiens
gcgggtgagaaaagctcaggtggggcccgccgggccgaaggaggtaacccggcgcccggccctagccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccagtgagtgttcccacatgcccttaa

SEQ ID NO: 1240 - DNA, 3353 bp, Homo sapiens
gcgggtgagaaaagctcaggtggggcccgccgggccgaaggaggtaacccggcgcccggccctagccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacc

SEQ ID NO: 1241 - DNA, 3404 bp, Homo sapiens
agagcgcagcggcgagcgtgactccgccatcaggtccccggctccctccccggacctagcccactccgctgcgccagcgccgcgggcaccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctgga

SEQ ID NO: 1242 - DNA, 559 bp, Homo sapiens
agagcgcagcggcgagcgtgactccgccatcaggtccccggctccctccccggacctagcccactccgctgcgccagcgccgcgggcagtgagttcggggatcaggggaacccggggctccctcgcaccaaccccaaatcctgccctcctggcgatgaggcttttctagggcacctctacaatccggccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcg

SEQ ID NO: 1243 - DNA, 2841 bp, Homo sapiens
tataaatgtcctagggaaggaggttattgcctttagcccctttttggggaagcgtctggaagtaagtcctgaggaatgaagtctcagaaagagggctgttgcagcagaggtgacctgtccattcagacaggtcctggaggagaatgggccccacggaggcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatggacatgatcgaggccatctcgttggtccgggaggtgacaggggtgaacgtgaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggagcacagtatcgagaccttcctcatcctgcgctgcacccagaagcggaaagaagagaaggccatgatcgccaagatgaaccgccagagaaccaactccatcgggcacaacccaccacactggggggctgagcgccccttctacaaccacctgggtggcaaccaggtgtccaaggagatgaagcggatgggctttgaagaccccaaggacaagaacgcccaggagagtgcgaaccctgaggatgaagtggatgagtttctgggccgtgccattgacgccaggagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggttggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtgccctgagcatgcaaccaaggtggcattgaaggtggtgacgcccatcatcatctcagtctttgtgctggccctgtacctgcacgcccagcaggtggagtccactgcccgcctcgacttcctctggaaactgcaggccacagaggagaaagaggagatggaggagctgcaggcctacaaccggcggctgctgcacaacatcctgcccaaggacgtggccgctcacttcctggcccgcgagcggcgcaatgatgagctctactatcagtcctgtgagtgtgtggcggtcatgttcgcctccatcgccaacttctccgagttctacgttgagctggaggccaacaacgagggtgtcgagtgcctgcggctactcaatgagatcatcgctgactttgatgagatcatcagcgaggatcggttccggcagctggagaagatcaagaccatcggcagcacctacatggctgcctccggcctcaacgactctacctacgacaaggtgggcaagacccacatcaaggcactggccgactttgccatgaagctgatggaccagatgaagtacatcaatgagcactccttcaacaacttccagatgaagatcgggctcaacatcggccccgtggtggccggggtgataggggcacgaaagcctcagtacgacatctggggcaataccgtgaacgtggccagccgcatggacagcaccggtgtacccgaccgcatccaggtcaccacagacatgtaccaggtgctggctgccaacacgtaccagctggagtgccggggcgtggtcaaggtcaagggcaaaggcgagatgatgacctacttcctcaatggagggcccccgctcagttagcagctgttggccaatggtgccaggcagcct

SEQ ID NO: 1244 - DNA, 7311 bp, Homo sapiens
gggcgagaagggaggagcggcgcgagcggccggagcggcgcagggcccgaagcgtgcatggcgcgccctgagccgggctcccgcgggcccccccggagcgcctctcgggcgccgcggctctcaggcgggcccctctgggccggctgcttctgagccccggcgctggatctctggatgccttactccccgggagaagcctgcctgcgtcggggcagaaccgcggcagcgctgcgccggattccgtcctccgcctagtcgttccgcgccggccgcggtgggcccgcagccggcgacgaggagcttggggcttgcgaagcgggcgcgacagctctccgggccggcaggtcccggccggccccgctccgtttgcgggaaagggagaggcgagaggggaagggccgcaccgcaggagccggtccctgacccggaccccgccccctgcgcggacgcgccgaaggctcggctcggctttcgccggggccacgcatccactctcgccgcgagaggtgggggatgcgggcaacggcccccccgggctccaggaccctcccccccggggctccggagctgttgctccgcccgtcgccccctcccccgtcctctccacctcccatcccacctccccacccctcgtaagaaaataatgctggctggcgcccgcacctcccagtcgctcccagtccgctgcgaggaaagcgcacccgcagtgtctcttcgccgggacccccgccgagccgccctcgccgccgccgagccccgagagcagctgggctccgcttaggcggaatcagcgagcgccgcgcccgggcactgccggcccgaggaggcaccgcccgcaaggacaccactccgtcccgtctcgtccgcaactccggccctcgtcgagctcgacgcgagccaggatcccggacgtctctccgcgtgcggcgcagcagcagccagaccagtccctgcgaccccacctcggaggcaactccatttcggacctgggacttctgacgcggatcctcagctacttctcacctcggggctgtgccctcctcctccgctcaggacgggggtgccaagatgccccgctgcagcgcagggccccgggccgcccccgacgtgtgaccctagcctggtccccctgctcggccgtccgccctccccttggagacccccggcccggcttccgggggaggaggaaggagacgacgaggccgagggggggatgtccggctccaaaagcgtgagccccccgggctacgcggcgcagaagactgcggcgccggcgccccggggaggccccgaacaccgctctgcgtggggcgaggccgattcccgcgcgaatggctacccccatgcccccgggggctctgcccgcggctccaccaagaaacccgggggggcggtgaccccgcagcagcagcagcgcctggccagccgctggcgcagcgacgacgacgacgatcctccgctgagcggtgacgaccccctggccgggggcttcggcttcagcttccgctccaagtccgcctggcaggagcgcggcggcgacgactgcggtcgcggcagccgccggcagcggcggggcgcggccagcgggggcagcacccgggcgccccctgcgggcggcggcggcggctcggcggcggcggctgcctcggcgggcgggacggaggtgcgccctcgctcggtggaggtgggtctggaggagcggcggggcaaggggcgcgcggccgacgagctggaggccggcgccgtcgagggcggcgaggggtccggggatggcggcagctcggcggactcgggctcgggcgcggggcccggcgcggtgctgtccctgggcgcctgctgcctggcgttgctgcagatattccgctccaagaagttcccgtcggacaaactggagcggctgtaccagcgctacttcttccgcctgaaccagagcagcctcaccatgctcatggccgtgctggtgctcgtgtgcctggtcatgttggccttccacgcggcgcggcccccgctccagctgccctacctggccgtgctggcggccgccgtcggcgtgatcctcatcatggctgtgctttgcaaccgcgccgccttccaccaggaccacatgggcctggcctgctatgcgctcatcgccgtggtgctggccgtccaggtggtgggcctgctgctgccgcagccacgcagcgcctctgagggcatctggtggaccgtgttcttcatctacaccatctacacgctgctgcccgtgcgcatgcgggccgcagtgctcagcggggtgctcctgtccgccctccacctggccatcgccctgcgcaccaacgcccaggaccagttcctgctgaagcagcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatggacatgatcgaggccatctcgttggtccgggaggtgacaggggtgaacgtgaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggagcacagtatcgagaccttcctcatcctgcgctgcacccagaagcggaaagaagagaaggccatgatcgccaagatgaaccgccagagaaccaactccatcgggcacaacccaccacactggggggctgagcgccccttctacaaccacctgggtggcaaccaggtgtccaaggagatgaagcggatgggctttgaagaccccaaggacaagaacgcccaggagagtgcgaaccctgaggatgaagtggatgagtttctgggccgtgccattgacgccaggagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggttggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtgccctgagcatgcaaccaaggtggcattgaaggtggtgacgcccatcatcatctcagtctttgtgctggccctgtacctgcacgcccagcaggtggagtccactgcccgcctcgacttcctctggaaactgcaggccacagaggagaaagaggagatggaggagctgcaggcctacaaccggcggctgctgcacaacatcctgcccaaggacgtggccgctcacttcctggcccgcgagcggcgcaatgatgagctctactatcagtcctgtgagtgtgtggcggtcatgttcgcctccatcgccaacttctccgagttctacgttgagctggaggccaacaacgagggtgtcgagtgcctgcggctactcaatgagatcatcgctgactttgatgagatcatcagcgaggatcggttccggcagctggagaagatcaagaccatcggcagcacctacatggctgcctccggcctcaacgactctacctacgacaaggtgggcaagacccacatcaaggcactggccgactttgccatgaagctgatggaccagatgaagtacatcaatgagcactccttcaacaacttccagatgaagatcgggctcaacatcggccccgtggtggccggggtgataggggcacgaaagcctcagtacgacatctggggcaataccgtgaacgtggccagccgcatggacagcaccggtgtacccgaccgcatccaggtcaccacagacatgtaccaggtgctggctgccaacacgtaccagctggagtgccggggcgtggtcaaggtcaagggcaaaggcgagatgatgacctacttcctcaatggagggcccccgctcagttagcagctgttggccaatggtgccaggcagcctggcctccagaggcatggaagcagcttctctgtgtgccgggggtggcggggaagccatgctccagcccgcagggctgcgctgctgagattttccacttggactccagagcagcttctgcctttgctggtgggcagcggcctctgtcccaggccccggggtgccagcgtcctgcgagcacccagctgaccaaagatgtttccctctgtagaagactctgctagactgggtctgaagcttgagttttctaacaggtgctgctgcacaggtggaaaggagccgtgggaatgtgtgtgtggcacggcccagacaagggcagggctgaggggcctccgactcagctgggggtagacgggctcgaatgtggcctgggagagcctagggggccccaggggtctgcttttctatgtgagcctttaaacttcagacaggccaccaccctgcacctgcaggggctttggcacaggagtgctggctttggagggactgtggccttcatcgtggtcctctgcccacacctccacgcacacagacagtgccctaggagggaaacagaactaattacgagggggaggcaagaggacgccaagcaaggagtggtgattctgagaaaaatatttattaaataaaacaaaacaagttctccgtgcccttctttagactatgctagttgtatgcgtgtaagagacacacaagcaaacgaggacgccactcggggggagggcggggatccccacttgtcttttttgtattttttattttgtattattgaaagccttggagatctcacagatagatatgccaaattctatattttgtaaattctctatattagaaaacagctgtgcacagcagggcgggtgtgctcatttgtactgtgtgtatgtcggtgtatgtactggtgtatatgtgtgtgtgttcatgctgtggaactggtctcacacaggatgtgtttccctcatttcagatttggcagttttgggttttccaaggtaccaccagagcagtgggtgtgtgcttttggggtaccatatgctcagattaagtaggaggatgcatggacacactgccccatcttttctgacacacgcacacgtatgtacacacatgcacacaccctccttcccctaagcaaaacgcagatggaataagaaaacaaaaagctgctttcccatcccaggccgagctggaaccaagggaagcaatctcatcctgcgacaggcagtgtggtgccctccacaccctgagatttcagacgtttgcggcttacagaggcagcgcccacagattccagagtgcttacagaaggccaggtgctttgcaggctgggacgaggaagccaagcctccctggcctactcagttggccaaggtgcaggtggctcttcctggagatgttcactcagactgggggatgcaatgtgcagccttcaggtttgcggaaagggagtggccttgacctccaccggcaaaccaggcagaggaatgggtagagcccagctttagagtccacagggaaagctagcaggaattttgttttagtgggagggggcagttaaacataccaagaaaaaaatactatttttataacctatgaggaagacatttggaaaatgatactctagcacagaattcagtggaatccttagggcccatgcccaaatctttccattgcttctcaggttagaatgatcttcacctccaacatgagcttggaggtgatgaggcagtggctctgtgccagctgccacaatgtgactttgatgtccacctgtaccacctctcactgggctctagcaccaccctcccctccccgcacaccaactgaacacagctctgagaagcaaagtgtgtggacccaaaactgccaagcctgagtctgtcccgtgcttctgctgctccatcctttgagttctgcattgccatcctgacgtcggccacaggaggcctgctttcttccagctgttgttctcaagttccctgcccctccacatcgcccgccagtggtgttgggttttcgttctgcttccaacctgagtaaagtgtgtgtgctgagttcatcccatgttctcccatggtcatggcttcccggccccatggggacccctctcccatcccagcagtgactggtgacagtgtgcaggtgcagtgctagctcttcgttccctctaaagggtgtgcactctttttattcctactcttgcaaaaacagatacgattatgatttcccatggaaattgaaaagtctatttaaataatttaactattaaacactttcactggtaa

SEQ ID NO: 1245 - DNA, 3962 bp, Homo sapiens
agatgcatggagggcctggaatcatgatgaggggaggggatgcggtgctctctcgggcaccggctgcactatcagcgttccctggagaaacagaacccttaggatttatatagacatatagaaagatttactgtgggggattggctcatgccgttacggagactgagaagacccatgagctgttgtctgtaagctggaggaccagaaaagccagtgacgtggtttcagtccaagcctgaaggcctgaaacccaggagagacaatgttgtaagtcccagcctaagtcagaggcctgagaaccaggagcccgctttccaagggcaggggaagatggatgtctcagctcaagaagagagtgaattctcccctcctctacctttttgctctattcaagccttcagtggatttgataacgcccacctgaatttggcaatctctggggcccctggatccctgctgaggtgcccatggtcccctccatccccacagggcagcctgtgtagtgctgggtagggcccaggcctgtcccacggaagacatggccccatctaggttccgcactcagttggagcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatggacatgatcgaggccatctcgttggtccgggaggtgacaggggtgaacgtgaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggagcacagtatcgagaccttcctcatcctgcgctgcacccagaagcggaaagaagagaaggccatgatcgccaagatgaaccgccagagaaccaactccatcgggcacaacccaccacactggggggctgagcgccccttctacaaccacctgggtggcaaccaggtgtccaaggagatgaagcggatgggctttgaagaccccaaggacaagaacgcccaggagagtgcgaaccctgaggatgaagtggatgagtttctgggccgtgccattgacgccaggagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggttggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtggagcctgtgtgagaacctcagacacaggagaatggaagctggtacctactttccctctggagtcaaggaacaaagccctgagcatgcaaccaaggtggcattgaaggtggtgacgcccatcatcatctcagtctttgtgctggccctgtacctgcacgcccagcaggtggagtccactgcccgcctcgacttcctctggaaactgcaggccacagaggagaaagaggagatggaggagctgcaggcctacaaccggcggctgctgcacaacatcctgcccaaggacgtggccgctcacttcctggcccgcgagcggcgcaatgatgagctctactatcagtcctgtgagtgtgtggcggtcatgttcgcctccatcgccaacttctccgagttctacgttgagctggaggccaacaacgagggtgtcgagtgcctgcggctactcaatgagatcatcgctgactttgatgagatcatcagcgaggatcggttccggcagctggagaagatcaagaccatcggcagcacctacatggctgcctccggcctcaacgactctacctacgacaaggtgggcaagacccacatcaaggcactggccgactttgccatgaagctgatggaccagatgaagtacatcaatgagcactccttcaacaacttccagatgaagatcgggctcaacatcggccccgtggtggccggggtgataggggcacgaaagcctcagtacgacatctggggcaataccgtgaacgtggccagccgcatggacagcaccggtgtacccgaccgcatccaggtcaccacagacatgtaccaggtgctggctgccaacacgtaccagctggagtgccggggcgtggtcaaggtcaagggcaaaggcgagatgatgacctacttcctcaatggagggcccccgctcagttagcagctgttggccaatggtgccaggcagcctggcctccagaggcatggaagcagcttctctgtgtgccgggggtggcggggaagccatgctccagcccgcagggctgcgctgctgagattttccacttggactccagagcagcttctgcctttgctggtgggcagcggcctctgtcccaggccccggggtgccagcgtcctgcgagcacccagctgaccaaagatgtttccctctgtagaagactctgctagactgggtctgaagcttgagttttctaacaggtgctgctgcacaggtggaaaggagccgtgggaatgtgtgtgtggcacggcccagacaagggcagggctgaggggcctccgactcagctgggggtagacgggctcgaatgtggcctgggagagcctagggggccccaggggtctgcttttctatgtgagcctttaaacttcagacaggccaccaccctgcacctgcaggggctttggcacaggagtgctggctttggagggactgtggccttcatcgtggtcctctgcccacacctccacgcacacagacagtgccctaggagggaaacagaactaattacgagggggaggcaagaggacgccaagcaaggagtggtgattctgagaaaaatatttattaaataaaacaaaac

SEQ ID NO: 1246 - DNA, 6464 bp, Homo sapiens
ccggtctataggtgcataccaccacaccaggctaatttttttttttttgagacggagtctcactctgtcacccaggctggagtgcaatggcgcgatctttgctcactgcaacctctgccacccgggttcaagcaattctcctgcctcagctcctgagtagctgggattacaggcgcccgccaccacgcccggctaatttttgtatttttagtagagacgaggtttcaccatcttggccaggctggtcttgaactcctgaccttgtgatctacctgccagggccttccaaagtgctgggattacggacgtgagccaccacgcctggcccaggctaattttttgaaattttaatagaggcagggtcttgctgtattgcccaggttgctctcacattcctagccttaagccatcctcctatctcggcctcacaaagtgctgggattacaggtgtaagccactgtgcctggttttgggcaagtttcttgtcctgactgtgtcttgggttctcacctgttgattggggatacccttgttgcctacctccaagtaattttatgaggatgaaactcatagcttgtcagtgggaagtgcttaggtaatgagctactagtggtggcagtggctgtgatggtggtattaataccactcctactggatggtctctaatactatctccttccttccctaccagcaacatgtcatggtttagtggcctcctggtccctaaagtggatgaacggaaaacagcctggggtgaacgcaatgggcagaagcgttcgcggcgccgtggcactcgggcaggtggcttctgcacgccccgctatatgagctgcctccgggatgcagagccacccagccccacccctgcgggcccccctcggtgcccctggcaggatgacgccttcatccggaggggcggcccaggcaagggcaaggagctggggctgcgggcagtggccctgggcttcgaggataccgaggtgacaacgacagcgggcgggacggctgaggtggcgcccgacgcggtgcccaggagtgggcgatcctgctggcgccgtctggtgcaggtgttccagtcgaagcagttccgttcggccaagctggagcgcctgtaccagcggtacttcttccagatgaaccagagcagcctgacgctgctgatggcggtgctggtgctgctcacagcggtgctgctggctttccacgccgcacccgcccgccctcagcctgcctatgtggcactgttggcctgtgccgccgccctgttcgtggggctcatggtggtgtgtaaccggcatagcttccgccaggactccatgtgggtggtgagctacgtggtgctgggcatcctggcggcagtgcaggtcgggggcgctctcgcagcagacccgcgcagcccctctgcgggcctctggtgccctgtgttctttgtctacatcgcctacacgctcctccccatccgcatgcgggctgccgtcctcagcggcctgggcctctccaccttgcatttgatcttggcctggcaacttaaccgtggtgatgccttcctctggaagcagctcggtgccaatgtgctgctgttcctctgcaccaacgtcattggcatctgcacacactatccagcagaggtgtctcagcgccaggcctttcaggagacccgcggttacatccaggcccggctccacctgcagcatgagaatcggcagcaggagcggctgctgctgtcggtattgccccagcacgttgccatggagatgaaagaagacatcaacacaaaaaaagaagacatgatgttccacaagatctacatacagaagcatgacaatgtcagcatcctgtttgcagacattgagggcttcaccagcctggcatcccagtgcactgcgcaggagctggtcatgaccctgaatgagctctttgcccggtttgacaagctggctgcggagaatcactgcctgaggatcaagatcttgggggactgttactactgtgtgtcagggctgccggaggcccgggccgaccatgcccactgctgtgtggagatgggggtagacatgattgaggccatctcgctggtacgtgaggtgacaggtgtgaatgtgaacatgcgcgtgggcatccacagcgggcgcgtgcactgcggcgtccttggcttgcggaaatggcagttcgatgtgtggtccaatgatgtgaccctggccaaccacatggaggcaggaggccgggctggccgcatccacatcactcgggcaacactgcagtacctgaacggggactacgaggtggagccaggccgtggtggcgagcgcaacgcgtacctcaaggagcagcacattgagactttcctcatcctgggcgccagccagaaacggaaagaggagaaggccatgctggccaagctgcagcggactcgggccaactccatggaagggctgatgccgcgctgggttcctgatcgtgccttctcccggaccaaggactccaaggccttccgccagatgggcattgatgattccagcaaagacaaccggggcacccaagatgccctgaaccctgaggatgaggtggatgagttcctgagccgtgccatcgatgcccgcagcattgatcagctgcggaaggaccatgtgcgccggtttctgctcaccttccagagagaggatcttgagaagaagtactcccggaaggtggatccccgcttcggagcctacgttgcctgtgccctgttggtcttctgcttcatctgcttcatccagcttctcatcttcccacactccaccctgatgcttgggatctatgccagcatcttcctgctgctgctaatcaccgtgctgatctgtgctgtgtactcctgtggttctctgttccctaaggccctgcaacgtctgtcccgcagcattgtccgctcacgggcacatagcaccgcagttggcatcttttccgtcctgcttgtgtttacttctgccattgccaacatgttcacctgtaaccacacccccatacggagctgtgcagcccggatgctgaatttaacacctgctgacatcactgcctgccacctgcagcagctcaattactctctgggcctggatgctcccctgtgtgagggcaccatgcccacctgcagctttcctgagtacttcatcgggaacatgctgctgagtctcttggccagctctgtcttcctgcacatcagcagcatcgggaagttggccatgatctttgtcttggggctcatctatttggtgctgcttctgctgggtcccccagccaccatctttgacaactatgacctactgcttggcgtccatggcttggcttcttccaatgagacctttgatgggctggactgtccagctgcagggagggtggccctcaaatatatgacccctgtgattctgctggtgtttgcgctggcgctgtatctgcatgctcagcaggtggagtcgactgcccgcctagacttcctctggaaactacaggcaacaggggagaaggaggagatggaggagctacaggcatacaaccggaggctgctgcataacattctgcccaaggacgtggcggcccacttcctggcccgggagcgccgcaatgatgaactctactatcagtcgtgtgagtgtgtggctgttatgtttgcctccattgccaacttctctgagttctatgtggagctggaggcaaacaatgagggtgtcgagtgcctgcggctgctcaacgagatcatcgctgactttgatgagattatcagcgaggagcggttccggcagctggaaaagatcaagacgattggtagcacctacatggctgcctcagggctgaacgccagcacctacgatcaggtgggccgctcccacatcactgccctggctgactacgccatgcggctcatggagcagatgaagcacatcaatgagcactccttcaacaatttccagatgaagattgggctgaacatgggcccagtcgtggcaggtgtcatcggggctcggaagccacagtatgacatctgggggaacacagtgaatgtctctagtcgtatggacagcacgggggtccccgaccgaatccaggtgaccacggacctgtaccaggttctagctgccaagggctaccagctggagtgtcgaggggtggtcaaggtgaagggcaagggggagatgaccacctacttcctcaatgggggccccagcagttaacagggcccagccacaaattcagctgaagggaccaaggtgggcattgagtggactctgtgctcactgggtggagctgtggcagggggcactgagcctccagaccctgctaaccacaaaagggaacatcccagcaggctgtgcttggatcatgctcgtctgccctcaagctggaaaacaaggggctacctaccgagaggattatgcaagtgactttctttcttacttggggtagggctgttccctctccaatcttccagcctttgggagcaggggaggggtcagtagcagaagcagagggaggcctcttgcctgagggattaaaatggcagcttgccatgcctacccttccctgtctgtctgggcagcaggttcagggctgagcccttcttttccctcttttttcctgggaatattttgtacaatattttgtacaaagacaggcatgaggagtgcctattccatgcttgcctttgcaatacctgcatccccagcactggtcctgggcacttccccaccccagccaggtgtccctcctatgcacagagcagaggagggagaagctctggggagccagctttggccatatttcaggagaatgtttccatgtgccaaatcttagtcccatgatctgtccccaaaggggaacaaagggacctctgacagcttagatttagccccagttcctgcacgctccagggaacggggtgtctggcctcactggtactgtgaaaaatgctcagagagcaagcctgtgtgtggggatgtcaggtcaggagctggaagttcacctgcaggtgccaaagagcaggccggccagggctggggcagtgccagactctgatctgaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggagtgggatggggtgtggtagcaaaaggagggagaggagtcctttttgtgccaaatccctaagtgccgttcgggggccatgtgtgcagcatgactctccctgtctgtggcagggacccaagcgcttgcttaagccccagtgctccatgccagcacttgaactgtctggggtttgatggacagaggctgaggaatttcctggcttccccagatagtgtcctgggacatggtatgctttggggctggggtagcatggaatccctctgaggacctggatactggtactacggggtggggaagaggaaccttaaacttggctttccccagccttcagcctgagtctagcatgtttctagctccccagtcccttgtgaagccttgagggctggcagaagggttaggaggttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggagtggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagagg

SEQ ID NO: 1247 - DNA, 6407 bp, Homo sapiens
tttttttttttttgagacggagtctcactctgtcacccaggctggagtgcaatggcgcgatctttgctcactgcaacctctgccacccgggttcaagcaattctcctgcctcagctcctgagtagctgggattacaggcgcccgccaccacgcccggctaatttttgtatttttagtagagacgaggtttcaccatcttggccaggctggtcttgaactcctgaccttgtgatctacctgccagggccttccaaagtgctgggattacggacgtgagccaccacgcctggcccaggctaattttttgaaattttaatagaggcagggtcttgctgtattgcccaggttgctctcacattcctagccttaagccatcctcctatctcggcctcacaaagtgctgggattacaggtgtaagccactgtgcctggttttgggcaagtttcttgtcctgactgtgtcttgggttctcacctgttgattggggatacccttgttgcctacctccaagtaattttatgaggatgaaactcatagcttgtcagtgggaagtgcttaggtaatgagctactagtggtggcagtggctgtgatggtggtattaataccactcctactggatggtctctaatactatctccttccttccctaccagcaacatgtcatggtttagtggcctcctggtccctaaagtggatgaacggaaaacagcctggggtgaacgcaatgggcagaagcgttcgcggcgccgtggcactcgggcaggtggcttctgcacgccccgctatatgagctgcctccgggatgcagagccacccagccccacccctgcgggcccccctcggtgcccctggcaggatgacgccttcatccggaggggcggcccaggcaagggcaaggagctggggctgcgggcagtggccctgggcttcgaggataccgaggtgacaacgacagcgggcgggacggctgaggtggcgcccgacgcggtgcccaggagtgggcgatcctgctggcgccgtctggtgcaggtgttccagtcgaagcagttccgttcggccaagctggagcgcctgtaccagcggtacttcttccagatgaaccagagcagcctgacgctgctgatggcggtgctggtgctgctcacagcggtgctgctggctttccacgccgcacccgcccgccctcagcctgcctatgtggcactgttggcctgtgccgccgccctgttcgtggggctcatggtggtgtgtaaccggcatagcttccgccaggactccatgtgggtggtgagctacgtggtgctgggcatcctggcggcagtgcaggtcgggggcgctctcgcagcagacccgcgcagcccctctgcgggcctctggtgccctgtgttctttgtctacatcgcctacacgctcctccccatccgcatgcgggctgccgtcctcagcggcctgggcctctccaccttgcatttgatcttggcctggcaacttaaccgtggtgatgccttcctctggaagcagctcggtgccaatgtgctgctgttcctctgcaccaacgtcattggcatctgcacacactatccagcagaggtgtctcagcgccaggcctttcaggagacccgcggttacatccaggcccggctccacctgcagcatgagaatcggcagcaggagcggctgctgctgtcggtattgccccagcacgttgccatggagatgaaagaagacatcaacacaaaaaaagaagacatgatgttccacaagatctacatacagaagcatgacaatgtcagcatcctgtttgcagacattgagggcttcaccagcctggcatcccagtgcactgcgcaggagctggtcatgaccctgaatgagctctttgcccggtttgacaagctggctgcggagaatcactgcctgaggatcaagatcttgggggactgttactactgtgtgtcagggctgccggaggcccgggccgaccatgcccactgctgtgtggagatgggggtagacatgattgaggccatctcgctggtacgtgaggtgacaggtgtgaatgtgaacatgcgcgtgggcatccacagcgggcgcgtgcactgcggcgtccttggcttgcggaaatggcagttcgatgtgtggtccaatgatgtgaccctggccaaccacatggaggcaggaggccgggctggccgcatccacatcactcgggcaacactgcagtacctgaacggggactacgaggtggagccaggccgtggtggcgagcgcaacgcgtacctcaaggagcagcacattgagactttcctcatcctgggcgccagccagaaacggaaagaggagaaggccatgctggccaagctgcagcggactcgggccaactccatggaagggctgatgccgcgctgggttcctgatcgtgccttctcccggaccaaggactccaaggccttccgccagatgggcattgatgattccagcaaagacaaccggggcacccaagatgccctgaaccctgaggatgaggtggatgagttcctgagccgtgccatcgatgcccgcagcattgatcagctgcggaaggaccatgtgcgccggtttctgctcaccttccagagagaggatcttgagaagaagtactcccggaaggtggatccccgcttcggagcctacgttgcctgtgccctgttggtcttctgcttcatctgcttcatccagcttctcatcttcccacactccaccctgatgcttgggatctatgccagcatcttcctgctgctgctaatcaccgtgctgatctgtgctgtgtactcctgtggttctctgttccctaaggccctgcaacgtctgtcccgcagcattgtccgctcacgggcacatagcaccgcagttggcatcttttccgtcctgcttgtgtttacttctgccattgccaacatgtacttcatcgggaacatgctgctgagtctcttggccagctctgtcttcctgcacatcagcagcatcgggaagttggccatgatctttgtcttggggctcatctatttggtgctgcttctgctgggtcccccagccaccatctttgacaactatgacctactgcttggcgtccatggcttggcttcttccaatgagacctttgatgggctggactgtccagctgcagggagggtggccctcaaatatatgacccctgtgattctgctggtgtttgcgctggcgctgtatctgcatgctcagcaggtggagtcgactgcccgcctagacttcctctggaaactacaggcaacaggggagaaggaggagatggaggagctacaggcatacaaccggaggctgctgcataacattctgcccaaggacgtggcggcccacttcctggcccgggagcgccgcaatgatgaactctactatcagtcgtgtgagtgtgtggctgttatgtttgcctccattgccaacttctctgagttctatgtggagctggaggcaaacaatgagggtgtcgagtgcctgcggctgctcaacgagatcatcgctgactttgatgagattatcagcgaggagcggttccggcagctggaaaagatcaagacgattggtagcacctacatggctgcctcagggctgaacgccagcacctacgatcaggtgggccgctcccacatcactgccctggctgactacgccatgcggctcatggagcagatgaagcacatcaatgagcactccttcaacaatttccagatgaagattgggctgaacatgggcccagtcgtggcaggtgtcatcggggctcggaagccacagtatgacatctgggggaacacagtgaatgtctctagtcgtatggacagcacgggggtccccgaccgaatccaggtgaccacggacctgtaccaggttctagctgccaagggctaccagctggagtgtcgaggggtggtcaaggtgaagggcaagggggagatgaccacctacttcctcaatgggggccccagcagttaacagggcccagccacaaattcagctgaagggaccaaggtgggcattgagtggactctgtgctcactgggtggagctgtggcagggggcactgagcctccagaccctgctaaccacaaaagggaacatcccagcaggctgtgcttggatcatgctcgtctgccctcaagctggaaaacaaggggctacctaccgagaggattatgcaagtgactttctttcttacttggggtagggctgttccctctccaatcttccagcctttgggagcaggggaggggtcagtagcagaagcagagggaggcctcttgcctgagggattaaaatggcagcttgccatgcctacccttccctgtctgtctgggcagcaggttcagggctgagcccttcttttccctcttttttcctgggaatattttgtacaatattttgtacaaagacaggcatgaggagtgcctattccatgcttgcctttgcaatacctgcatccccagcactggtcctgggcacttccccaccccagccaggtgtccctcctatgcacagagcagaggagggagaagctctggggagccagctttggccatatttcaggagaatgtttccatgtgccaaatcttagtcccatgatctgtccccaaaggggaacaaagggacctctgacagcttagatttagccccagttcctgcacgctccagggaacggggtgtctggcctcactggtactgtgaaaaatgctcagagagcaagcctgtgtgtggggatgtcaggtcaggagctggaagttcacctgcaggtgccaaagagcaggccggccagggctggggcagtgccagactctgatctgaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggagtgggatggggtgtggtagcaaaaggagggagaggagtcctttttgtgccaaatccctaagtgccgttcgggggccatgtgtgcagcatgactctccctgtctgtggcagggacccaagcgcttgcttaagccccagtgctccatgccagcacttgaactgtctggggtttgatggacagaggctgaggaatttcctggcttccccagatagtgtcctgggacatggtatgctttggggctggggtagcatggaatccctctgaggacctggatactggtactacggggtggggaagaggaaccttaaacttggctttccccagccttcagcctgagtctagcatgtttctagctccccagtcccttgtgaagccttgagggctggcagaagggttaggaggttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggagtggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagaggagtcaggaggtgggaggccgtgggctttggttttataatgtaaccactgtgggggtgggggaggatggtgaaccatgtatttcagtgaaatatttaatatatttaaatatcaataaaatcaaactctttgtaaaatt

SEQ ID NO: 1248 - DNA, 5877 bp, Homo sapiens
cggacggcggacggcgggcgggacggccaggacgcgcgggctcggaggaccgcgggacggccggccggccggccggagcccgcgggggcggcggggcgggggcccagggcaggcgcggagccgggccggcagcaacatgtcatggtttagtggcctcctggtccctaaagtggatgaacggaaaacagcctggggtgaacgcaatgggcagaagcgttcgcggcgccgtggcactcgggcaggtggcttctgcacgccccgctatatgagctgcctccgggatgcagagccacccagccccacccctgcgggcccccctcggtgcccctggcaggatgacgccttcatccggaggggcggcccaggcaagggcaaggagctggggctgcgggcagtggccctgggcttcgaggataccgaggtgacaacgacagcgggcgggacggctgaggtggcgcccgacgcggtgcccaggagtgggcgatcctgctggcgccgtctggtgcaggtgttccagtcgaagcagttccgttcggccaagctggagcgcctgtaccagcggtacttcttccagatgaaccagagcagcctgacgctgctgatggcggtgctggtgctgctcacagcggtgctgctggctttccacgccgcacccgcccgccctcagcctgcctatgtggcactgttggcctgtgccgccgccctgttcgtggggctcatggtggtgtgtaaccggcatagcttccgccaggactccatgtgggtggtgagctacgtggtgctgggcatcctggcggcagtgcaggtcgggggcgctctcgcagcagacccgcgcagcccctctgcgggcctctggtgccctgtgttctttgtctacatcgcctacacgctcctccccatccgcatgcgggctgccgtcctcagcggcctgggcctctccaccttgcatttgatcttggcctggcaacttaaccgtggtgatgccttcctctggaagcagctcggtgccaatgtgctgctgttcctctgcaccaacgtcattggcatctgcacacactatccagcagaggtgtctcagcgccaggcctttcaggagacccgcggttacatccaggcccggctccacctgcagcatgagaatcggcagcaggagcggctgctgctgtcggtattgccccagcacgttgccatggagatgaaagaagacatcaacacaaaaaaagaagacatgatgttccacaagatctacatacagaagcatgacaatgtcagcatcctgtttgcagacattgagggcttcaccagcctggcatcccagtgcactgcgcaggagctggtcatgaccctgaatgagctctttgcccggtttgacaagctggctgcggagaatcactgcctgaggatcaagatcttgggggactgttactactgtgtgtcagggctgccggaggcccgggccgaccatgcccactgctgtgtggagatgggggtagacatgattgaggccatctcgctggtacgtgaggtgacaggtgtgaatgtgaacatgcgcgtgggcatccacagcgggcgcgtgcactgcggcgtccttggcttgcggaaatggcagttcgatgtgtggtccaatgatgtgaccctggccaaccacatggaggcaggaggccgggctggccgcatccacatcactcgggcaacactgcagtacctgaacggggactacgaggtggagccaggccgtggtggcgagcgcaacgcgtacctcaaggagcagcacattgagactttcctcatcctgggcgccagccagaaacggaaagaggagaaggccatgctggccaagctgcagcggactcgggccaactccatggaagggctgatgccgcgctgggttcctgatcgtgccttctcccggaccaaggactccaaggccttccgccagatgggcattgatgattccagcaaagacaaccggggcacccaagatgccctgaaccctgaggatgaggtggatgagttcctgagccgtgccatcgatgcccgcagcattgatcagctgcggaaggaccatgtgcgccggtttctgctcaccttccagagagaggatcttgagaagaagtactcccggaaggtggatccccgcttcggagcctacgttgcctgtgccctgttggtcttctgcttcatctgcttcatccagcttctcatcttcccacactccaccctgatgcttgggatctatgccagcatcttcctgctgctgctaatcaccgtgctgatctgtgctgtgtactcctgtggttctctgttccctaaggccctgcaacgtctgtcccgcagcattgtccgctcacgggcacatagcaccgcagttggcatcttttccgtcctgcttgtgtttacttctgccattgccaacatgtacttcatcgggaacatgctgctgagtctcttggccagctctgtcttcctgcacatcagcagcatcgggaagttggccatgatctttgtcttggggctcatctatttggtgctgcttctgctgggtcccccagccaccatctttgacaactatgacctactgcttggcgtccatggcttggcttcttccaatgagacctttgatgggctggactgtccagctgcagggagggtggccctcaaatatatgacccctgtgattctgctggtgtttgcgctggcgctgtatctgcatgctcagcaggtggagtcgactgcccgcctagacttcctctggaaactacaggcaacaggggagaaggaggagatggaggagctacaggcatacaaccggaggctgctgcataacattctgcccaaggacgtggcggcccacttcctggcccgggagcgccgcaatgatgaactctactatcagtcgtgtgagtgtgtggctgttatgtttgcctccattgccaacttctctgagttctatgtggagctggaggcaaacaatgagggtgtcgagtgcctgcggctgctcaacgagatcatcgctgactttgatgagattatcagcgaggagcggttccggcagctggaaaagatcaagacgattggtagcacctacatggctgcctcagggctgaacgccagcacctacgatcaggtgggccgctcccacatcactgccctggctgactacgccatgcggctcatggagcagatgaagcacatcaatgagcactccttcaacaatttccagatgaagattgggctgaacatgggcccagtcgtggcaggtgtcatcggggctcggaagccacagtatgacatctgggggaacacagtgaatgtctctagtcgtatggacagcacgggggtccccgaccgaatccaggtgaccacggacctgtaccaggttctagctgccaagggctaccagctggagtgtcgaggggtggtcaaggtgaagggcaagggggagatgaccacctacttcctcaatgggggccccagcagttaacagggcccagccacaaattcagctgaagggaccaaggtgggcattgagtggactctgtgctcactgggtggagctgtggcagggggcactgagcctccagaccctgctaaccacaaaagggaacatcccagcaggctgtgcttggatcatgctcgtctgccctcaagctggaaaacaaggggctacctaccgagaggattatgcaagtgactttctttcttacttggggtagggctgttccctctccaatcttccagcctttgggagcaggggaggggtcagtagcagaagcagagggaggcctcttgcctgagggattaaaatggcagcttgccatgcctacccttccctgtctgtctgggcagcaggttcagggctgagcccttcttttccctcttttttcctgggaatattttgtacaatattttgtacaaagacaggcatgaggagtgcctattccatgcttgcctttgcaatacctgcatccccagcactggtcctgggcacttccccaccccagccaggtgtccctcctatgcacagagcagaggagggagaagctctggggagccagctttggccatatttcaggagaatgtttccatgtgccaaatcttagtcccatgatctgtccccaaaggggaacaaagggacctctgacagcttagatttagccccagttcctgcacgctccagggaacggggtgtctggcctcactggtactgtgaaaaatgctcagagagcaagcctgtgtgtggggatgtcaggtcaggagctggaagttcacctgcaggtgccaaagagcaggccggccagggctggggcagtgccagactctgatctgaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggagtgggatggggtgtggtagcaaaaggagggagaggagtcctttttgtgccaaatccctaagtgccgttcgggggccatgtgtgcagcatgactctccctgtctgtggcagggacccaagcgcttgcttaagccccagtgctccatgccagcacttgaactgtctggggtttgatggacagaggctgaggaatttcctggcttccccagatagtgtcctgggacatggtatgctttggggctggggtagcatggaatccctctgaggacctggatactggtactacggggtggggaagaggaaccttaaacttggctttccccagccttcagcctgagtctagcatgtttctagctccccagtcccttgtgaagccttgagggctggcagaagggttaggaggttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggagtggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagaggagtcaggaggtgggaggccgtgggctttggttttataatgtaaccactgtgggggtgggggaggatggtgaaccatgtatttcagtgaaatatttaatatatttaaatatcaataaaatcaaactctttgt

SEQ ID NO: 1249 - DNA, 6130 bp, Homo sapiens
agctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaagttaaacgaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgaccagacttgttggggtcctgggatgagttgccccgggctgcaaattaagagtacagctaagtgcgggggtggcggtggagggaacgaaaattgaacctgtctgcctgtgctgtgtcgtgtggctttatcagcccgaggaagggcaggtgtattctaatttgcacaaaggtgctgggtagactagtggcagctctcatgtgctgcacataagtggaatcagtatgaatagaagaacttgctgtataaaggaatttcatggcaacaatgctggtaagggcaattagcctcgcttaagttgccttttttacacaccaaaactttttacatgaagggctggtttcacatgaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtaaaagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctcctgagttaacttttgtgaaaataatacctaaggttttctggcttattgaggaaatttcctaacaaacaaacaaacaaacaaacagaagagaagatcattaaccactgtatactttgtgtatataataggtcagtgtaaagaaatatgatttgaggtggtgcatgcaagtaactagggtttattctatataatgaatatttatagatctgtaacatttgtttcaaaatgctgtttcatttttataaagtaccagtgtttagctgctttttatacattaaattagcaatttg

SEQ ID NO: 1250 - DNA, 6162 bp, Homo sapiens
gtggaaggagccttcggatggagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaagttaaacgaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgaccagacttgttggggtcctgggatgagttgccccgggctgcaaattaagagtacagctaagtgcgggggtggcggtggagggaacgaaaattgaacctgtctgcctgtgctgtgtcgtgtggctttatcagcccgaggaagggcaggtgtattctaatttgcacaaaggtgctgggtagactagtggcagctctcatgtgctgcacataagtggaatcagtatgaatagaagaacttgctgtataaaggaatttcatggcaacaatgctggtaagggcaattagcctcgcttaagttgccttttttacacaccaaaactttttacatgaagggctggtttcacatgaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtaaaagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctcctgagttaacttttgtgaaaataatacctaaggttttctggcttattgaggaaatttcctaacaaacaaacaaacaaacaaacagaagagaagatcattaaccactgtatactttgtgtatataataggtcagtgtaaagaaatatgatttgaggtggtgcatgcaagtaactagggtttattctatataatgaatatttatagatctgtaacatttgtttcaaaatgctgtttcatttttataaagtaccagtgtttagctgctttttatacattaaattagcaatttgaaaaactcaaa

SEQ ID NO: 1251 - DNA, 2090 bp, Homo sapiens
gagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgcacctgcatactgttttttcccgtttaaatgagctcacttcataagaaataaaactacagtg

SEQ ID NO: 1252 - DNA, 2496 bp, Homo sapiens
actctcattaggtagcgtggaaggagccttcggatggagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgcacctgcatactgttttttcccgtttaaatgagctcacttcataagaaataaaactacagtgaaaacaac

SEQ ID NO: 1253 - DNA, 5938 bp, Homo sapiens
actggctgcagccgcagtcttggtggaggaggtggtgaccaccaccgctcctccacctgcatccggctgcgggactgcggcggccgcgtttgccctgcagaccctgcaccccgggacgcggctcatctgtcattagcaccggcactaagctcccaccgctcagcgacttggtccgccgcaagctccgccgcaggctttgtccgctagcgctcggctgagtctgggcgggcgggaaacctgggctagggcgaggcggggcccctggacatgcctttctccacgtccgcctcctcgaccctattgtaagcggagaaacttagtgtgcgaggcaggcaggggacgtccccattttgatgtcccgtaccctccacccccttcggatcgaggtagtaaagaggctcctgtaggaaactgactgcctctatgattgcggcctcttgggggattttgcgtttagcccgaaagttggctttgccaaaagacgcacgggtaggaagggcgaaaaggaaaccctgtattccgtcgcgctgggctctccgagtccgtgcgcaaagcggcctacgagtcctggctccgcacctgcagaggacaagagccaatgcctaaaaaagaacagcggaggaaccggctggcgcggccagctggaacgctggatcgcagtgcgcccagggaaggccgggggcgcccgccggccctagccctcagtggtcctctcccacgccggcccgcgcgtgcctctgcctacaagacctggggcgtcctggccagatctggatggcaggtccctccgccacccccggcccggttccgggggcgtggcttggcgcgggggcgggtttaagtcaccgcgggtgtctgaccactctgacaggtctccaaatttctcccagtcgcctggcgcccgcggtgcgtttcagagctccagggtggcacgcggcggcgcttccctagatccagaggcgtctctgtcgacttccacgcggcctcgggcctcccttctcctccaaaccttcgcctcatccgccaagcttcggttctcagcctcagatatccgcaccggcggcttctcttcgttctcggagctcttggctttggagccctcaccactttttccttcccccgcctctcctgatcctcctagctccgagccaaatggactccaaagaacgaaataaaggggatgagaactgtgtgctgcgacccttcgaaagcacagctgaaagcgttgacctcgtcttatagctcaggctgggaccctggagcgagagtccccacaccccctccgggagggatgcttctggccagagccagcgctgcgctgtcagtccttgctcccgaactaggaaagagcctaggagggagcctcagcataccccttcctccaaattaactatttggtgaattgttagcgccgaggctaccacctctccaaccctgtcgcggggcgccccgccacctcaccgtgaccccctcctcctccttctttgcccccgcccccagctccgcccctgctccccatcccggcgcaatggagttctccgaagggcgatgattccagccacatctgctaacttcgcacccatcgctgccgccggtcaccgccggccaggccccctgcagccgcggagcagtgggcgtccaaagcccagtgcagcagccaggacccgcccgacgcgcagcagaagcacggcgcccaggcgcttaggcgtctcttggagagcaaaggctgcgccaaaacgctgagcctagaatcaaccaaggagcctgagcccaggaaggggctgcgtggctcacagcgctgcggctcctgaggacaaatagccactgccgctgcgtacccaagctgcgccggctggcgggagagcagcacgcaaggacgccgaggtccgccgcgatcttccaggtgccctttgcccctgggcacagtatgacccgacctacagggagccctagcgcagggctcctgcaacggggcagcctaggataaaaaggatccttgccaagctcctaccaggccgcctttgagtctttaggaacccctcctccggctgcctccccaaggttctgggcctccttccctgcggcccagagccatggagctctccgatgtgcgctgccttacaggcagcgaggaactctacaccatccacccgacgcccccggccggcgacggcaggagcgcctcccggccgcagcggctgctgtggcagacggcggtgcgacacatcacggagcagcgcttcattcacgggcaccggggaggcagcggcagcgggagtggaggctcgggcaaagcctcggaccctgcgggcggcggccccaaccaccacgcgccgcagctgtcaggcgactcggcgctgcccctctactcgctgggcccgggagagcgagcgcacagcacctgcggcaccaaagtcttcccggaacgcagcgggagcggcagtgccagcggcagcggaggcgggggcgacctgggcttcctgcaccttgactgtgcccctagcaactcggatttctttcttaatgggggctatagctaccgaggggtcattttccccaccctgcgcaactccttcaaatctcgggatttggaacgcctctaccagcgctatttcttgggccaaaggcgcaaatcggaagtggtgatgaacgtgctggacgtgctgaccaaactcactctcttggtcctacacttgagcctggcctcggcccccatggacccgctcaagggcatcctgctgggcttcttcaccggcattgaggtagtgatctgcgccctggtggtggtcaggaaggacaccacctcccacacgtacctgcagtacagcggcgtggtcacctgggtggccatgaccacccagatcctggcagcaggcctcggctacgggctcctgggcgacggcataggctacgtgctcttcacgctcttcgccacctacagtatgctgccgctgccgctcacctgggccatcctggccggcctgggcacctcgctgctgcaggtcatcctccaagtggtcataccccggctggcggtcatttccatcaaccaggttgtggcccaggcagtgctattcatgtgtatgaacacagctggaatcttcatcagttacctgtcagaccgggcccagcgccaagctttcctggagactcggaggtgtgtggaggccaggctgcgcctggagacagagaaccaaagacaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactaaggaagtggcagtttgatgtctggtcttgggatgtggatattgcaaacaaactcgaatctggaggaatccctgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatactctggctgccctaacaagaaattcaataaatctgcttccaaaccatcttgcacaagctttgcatgtccagtctgggcctgaggaaattaacaagagaatagaacataccatcgacttgcggagtggcgataaattgagaagagagcatatcaagccattctcactgatgtttaaagactccagcctggagcacaagtattctcaaatgagggatgaagtgttcaagtcaaacttggtctgtgcatttatcgttcttctatttatcacggcaatacaaagtttgcttccttcttcaagagtgatgccaatgaccatccagttctccattctgattatgctgcactcggctctggtcctcatcaccacagcagaggattataaatgtttgcccctcatcctccggaaaacttgctgttggattaatgagacctatttggcccggaacgtcatcatctttgcatccattttgattaatttcctgggtgccatcttaaatatcctgtggtgtgattttgacaagtcgatacccttgaagaacctgactttcaattcctcagctgtgtttacagatatctgctcctacccagagtactttgtcttcacgggggtgttggccatggtgacctgtgcagttttcctccggctgaactccgtcctgaagctggcagtgctgctgatcatgattgccatctatgccctgctcactgagaccgtctacgcaggcctctttctgcgttatgacaacctcaaccacagtggagaagatttcctggggaccaaggaggtatcactgctactgatggccatgttcctcctggctgtgttctaccatggacagcagctggagtacacagcccgcctggacttcctttggcgagtacaggccaaagaggagatcaatgagatgaaggagctgagggaacacaatgagaacatgctccggaatatcttacccagccatgtggcccgccatttcctagagaaggaccgagacaatgaggagctgtattctcaatcctatgatgctgttggggtgatgtttgcctccatcccaggatttgcggacttttactctcagactgaaatgaataaccagggagtggaatgcctgcgcttgctcaatgagatcattgctgacttcgatgagttgcttggtgaagaccgatttcaagacattgaaaagattaagaccattggcagcacctacatggccgtgtcaggcctgtcacctgaaaaacagcaatgtgaagacaagtggggacatttgtgtgctctggctgacttctcactcgccctgacagaaagcatacaggagatcaacaagcattcattcaacaattttgaactccggattggcatcagccacggctcagtggtagctggcgttatcggcgctaagaaaccacagtatgacatttggggcaaaactgtgaacctggcaagccgaatggacagcacgggggttagtggccggatccaagtcccagaggagacctatctcatcctgaaggaccagggctttgcctttgattaccgaggggagatctatgtgaagggtatcagtgaacaggaaggaaaaatcaaaacgtactttcttctgggaagagtccaacccaacccattcatcttgcccccaagaagactgcctgggcagtactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataaaagcattttctttctgttttttttttttgtatttcttttatatataaaataaatatactaataaaaaggtttaattttttttagaacaa

SEQ ID NO: 1254 - DNA, 7720 bp, Homo sapiens
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgagccgggggcgcccgccgaagctcgctgctccgggtcggggtccgggcccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccaccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccatgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgttcctctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccatcgggagtggaggtgttggtcctggaagctgactcatcggagagggaaataccaaataaacatccgaggttgcatttatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgctgatgaggcccagggtgcactccttgtcagtcttgcccgttgtccctgtgcattttgctttccgctgtcaaatctcactgtctcgttttcacaccgcatcagtccccatcatcactactcctccccagagacatacagattgccctccccggcatgaagaagtcacaattctgacccgccacctctccaggggcggtgcctgggatggccacccatcaggacagccagagccagggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggagagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaattt

SEQ ID NO: 1255 - DNA, 531 bp, Homo sapiens
atgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcgatggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtag

SEQ ID NO: 1256 - DNA, 3206 bp, Homo sapiens
ggtaagggagggaaaatcttaccaaagcgaccggctcactcgactgctgattctttcgcttggcatcgcgtcaggggagttagctttccttcagccgggtctggctagttattgggcgccgggtagatgcatatataaatgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcgatggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatatatatatatataaagtatagagagaagttcatacaaagcgtgcacaaggattgaaaattcgcccgagctgtttatgtttttataaaaataaatagaaaagtagacaatcattgttttgaatattactcctatttttgtaaactggaattaaaaggatagtatttttatccatgacaggcctgaagatattactacttaccatttgctactgtacataaacaatgatgccctgctccagggagattttgaggtaaagatatggagaattgctgaagggcattctttcccagtgagtctctggggcaggctgcttcaatcccagcctaactcaactgggctctgtccccctggttgggtggcaattccaatatttctgctttctttgattctccttttatgtgtagttgtctctcttcagactctcagcccagaagaaaattctcctgataaaacaacagctcgatccaaattgtgcttctccccagaattcacgcctctccctaggagaagagttgaggaactgtacagaaaagggcggcttcgttagaccgctctcttttctgtacttcctgagtggccagggaatctaatatccccaaattagggcaattggaacaaagtgaaggacatagaggtatattggaagaggcagagcctgaggtggtaggaggaggaccctggaaatggactggtttgagattgccccaggtctgggaagctgagggcaaatccagtcccaatggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcactttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaaccaacctttgtcatattagaatgtgtagtgttcacatgttgctcagttttgctaactgataaatcatttaatcctcttcttcatatgtatgagtactatcttatatctgtggtcaagagtgaggtaagcaagctccaacagaccctgagaacctacgcttgtatcctttctttggctaaagaaagcatgtctgtttcctgtcaattctttgaacatacagagtaatctttataaacaaaagaaccttcacccagcaatcagatcgagcagcaacagacaaaccagccagccaatctcccaaatttcaggcacaagtttatttatttatttttttatgttttgaaaaaagaagatgaagaagaagaaaaaaaaaagaacaaggaaagattaaacgttagcttgtaaagtttaaaggacctttccttttcctttacggatttgatcagtatgaagtcataaatcaaagaaaacagaattggatttgcattcccaggcgggatggatgctgccaggagatcacattgcaaatagtgaaaacagaggcattcggtctatgcctgagtcctgtgtataggatcaatcttcctttaattccgcagtctcctcaggcaatgtgacacgggatgcagtttgcagctttagtgcctttcttcgccttttaaattgccacgaatcacagatggctatttagtggccctacaatgctgcaacacatcagcttgcattttagtcttaattatttgtttcttggataatgggcagagttttctgtatttgtatcagctgttagtggtgaaatagggctctagttaaccttttatttatgaagtctaatttagtgttcccgtggctagttgcaagcattttacagtgatcacccagtttaatcttttgtatactttttagaaatgccaagagccttactaaactgaagcagatttatgatatagtgataatttaggtagatgttagtcttgaagctcttattttgtgtgcaactgattataaaaacaccttaaccaagtattattacacacatgatatctataactaggactttgataactgttatataaagtgtgtaaaatttgtatgaataaatttttgtaaacaatgcaa

SEQ ID NO: 1257 - DNA, 1278 bp, Homo sapiens
attctgtacttaaaggcaacaggcaggcagatgttgacaaagagggctctccaaaaaccatgttcggatagatttttgcgaactgcacagataaataggagcagaaggccggtcacctctgtaaccagcggtagcagcagcagaagccgcgcttcacctcatcgccccctctttctttcttctgcctctctctctgcgcccccttctctccgtgtcacgctccctcctggttctgcgcgtctacaaacttttgagcagaacacgagcctcggcaaacgagtcccgcagctcctcctgctgctcccgctggttcctgcggcttctgctcagacaccaacgccagacggcgatgcctctcgggtggtgactccagcgcaggaacttgaagaagcgctttgcccgccgtcctacctggcagctctcctggcagcgggaggagttgaaggaatgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcgatggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatatatatatatataaagtatagagagaagttcatacaaagcgt

SEQ ID NO: 1258 - DNA, 3346 bp, Homo sapiens
attctttcgcttggcatcgcgtcaggggagttagctttccttcagccgggtctggctagttattgggcgccgggtagatgcatatatatatatttttttctaactatagcaagcaagaagtggcagggcgcgcaccggctgtcgccaagtgctgttcaactcagggagccggggcttcgctccgtccctcccccggcttccagagctttttggggttggagggtgggaggccaggggcgttctcacagctgtgtgtcctctttcccatcctgcgcagaatgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcgatggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatatatatatatataaagtatagagagaagttcatacaaagcgtgcacaaggattgaaaattcgcccgagctgtttatgtttttataaaaataaatagaaaagtagacaatcattgttttgaatattactcctatttttgtaaactggaattaaaaggatagtatttttatccatgacaggcctgaagatattactacttaccatttgctactgtacataaacaatgatgccctgctccagggagattttgaggtaaagatatggagaattgctgaagggcattctttcccagtgagtctctggggcaggctgcttcaatcccagcctaactcaactgggctctgtccccctggttgggtggcaattccaatatttctgctttctttgattctccttttatgtgtagttgtctctcttcagactctcagcccagaagaaaattctcctgataaaacaacagctcgatccaaattgtgcttctccccagaattcacgcctctccctaggagaagagttgaggaactgtacagaaaagggcggcttcgttagaccgctctcttttctgtacttcctgagtggccagggaatctaatatccccaaattagggcaattggaacaaagtgaaggacatagaggtatattggaagaggcagagcctgaggtggtaggaggaggaccctggaaatggactggtttgagattgccccaggtctgggaagctgagggcaaatccagtcccaatggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcactttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaaccaacctttgtcatattagaatgtgtagtgttcacatgttgctcagttttgctaactgataaatcatttaatcctcttcttcatatgtatgagtactatcttatatctgtggtcaagagtgaggtaagcaagctccaacagaccctgagaacctacgcttgtatcctttctttggctaaagaaagcatgtctgtttcctgtcaattctttgaacatacagagtaatctttataaacaaaagaaccttcacccagcaatcagatcgagcagcaacagacaaaccagccagccaatctcccaaatttcaggcacaagtttatttatttatttttttatgttttgaaaaaagaagatgaagaagaagaaaaaaaaaagaacaaggaaagattaaacgttagcttgtaaagtttaaaggacctttccttttcctttacggatttgatcagtatgaagtcataaatcaaagaaaacagaattggatttgcattcccaggcgggatggatgctgccaggagatcacattgcaaatagtgaaaacagaggcattcggtctatgcctgagtcctgtgtataggatcaatcttcctttaattccgcagtctcctcaggcaatgtgacacgggatgcagtttgcagctttagtgcctttcttcgccttttaaattgccacgaatcacagatggctatttagtggccctacaatgctgcaacacatcagcttgcattttagtcttaattatttgtttcttggataatgggcagagttttctgtatttgtatcagctgttagtggtgaaatagggctctagttaaccttttatttatgaagtctaatttagtgttcccgtggctagttgcaagcattttacagtgatcacccagtttaatcttttgtatactttttagaaatgccaagagccttactaaactgaagcagatttatgatatagtgataatttaggtagatgttagtcttgaagctcttattttgtgtgcaactgattataaaaacaccttaaccaagtattattacacacatgatatctataactaggactttgataactgttatataaagtgtgtaaaatttgtatgaataaatttttgtaaacaatgcaa

SEQ ID NO: 1259 - DNA, 6487 bp, Homo sapiens
gcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaacagccccccatcatctgattttgggtgtgacccctcgagtgtgcatgccaccctggggctcttctcagtcctgggcccaagtccctgaagcctagcagagggccagctcgggtggccagaacaccccttggtgcaggcctcctggcactcgcctggcatcttggtgtccgggtgctcagctcctgggtcccagggcagtgggacagctcccaggctcttctcatcagagacttcagtttgggtggggagtctgcaggtcagggaaggttctggtgcttttcgtttgatccaaaaggagctgagagccagaaatgtggctgtgattgcgaaagagacggagtttgggagacccatggaagaaaaccttcgccatctccattgttttacccccagctcaagatggacagggttcttctggtcatctcccttccacctcttccaccctcatggatgccttccagaagctgtctccaaccatgcacaccacagagagcccttaagccctcccctccccatttcccctaagtcaaagccatgactaggatgtaccagccacctgcctctgatgtcggcgaatcctgaagcacctgcacccgaatctggggcccagggctgcccgacccccactcccatggatgatgaggagccccagacaccagctcctctggcctggactcaactattgaaatctctctgagacctctgcaaagatgtcccttttatgcccttgaccttgactcaccatgggctgctggggtgtcgggagaagccacacccaacatgcccattagcagaggctgctgctgatgtggcagctgctccctaccacccgccctggctccccagctgcaggttgcacaccctcagcctgagaatgtaaaatagggcagtgcccagctggggaggtagaggaaagtgctagagtacatggtccgtgtgtggcctagctcattccatgtcagcatttggtgttactcctgtccaaattctgtttgcagacttgtttcatgatgatgctctggaatgcttggggactttgggtggaggaggatgttacttcattttataaagaggaaggggcctgggagacttgggaaaatgtttctggagaggctttcagagtggctggaaaaggctcttgttgctgtaatttagagaggagctctgtgtccttggccagtcaagtaagttcctggatctttggcaaagccagaggaagaaaggagctacctgccctttcctgggcatgcttggtgactcagattgatcttggagtgtgcagtggcccttctaccctgcacctgacctcatgatcccctccacctgcactggtgtgcattactgaagcaagggtcctgtggacatcttgcattttgggcactgctagggggtctgggctgcttggaaggagccatggcctagggttcagggaactagactctatcccagttgggttcagactgctgtgactgtggacacgatgctccttgttctgggctccagttttcccatttgtgagatgaggcaacttccaatgcttctctaggccctgcacgtaagtgatttttccagttcaaagtcaagacaggtaaaagggcattcatcattgtgcctcatatcaggttttgatgaatatatgtgtgtgtgtgtgtgtgtgtgtgtgtgtgtgtgtagagggatggacaggatgctgtttattttccctttcttggaaatggaccttctgtcccttccatttggacaccacagtggaagctggtggcctggaaggaaggattaggtcatggacatttgaacaggtgccttgggcatgatgtatagatgcagtcatatataccttgctggggtggggtgccacctccagtggccagctccagatccaaggagcagccccctggggatggaccccattcattcatcatgactcccaacagttttcattgtggaagaagaaactttggcattatagagacatcatcacaaaacagtaaaaacaaaatcaaccctgaaccccatgcactgtgctgcttcctgagcctggccctgcatcctcatagaggtgccgggttcctattggttagttggttgtttttccgtctgagtgaatttttgccagtcttgtgagcagatgtacctgatgtattctcaatgttccaagaggttctggccttcagggtcacaggcagtagggggacagcataaggtctatgtaaaacccttccctctctgaccctctgttttcaaatctgtaaaatgggcaataagactagatgatttgtatatagcccaatgcatctctggaactctgtctaaacaccagccatctacttggaatgggccccaggactgtggtatttgcctgggccaggaaaggataagaaatcctgtcatgtgaagacagcttgagaggcttgagaaaagtggggctggggagaagcaggcttgtcagactccacccctgttgatgatcattcctgggaaggggtttctcgttctatgcaatcctaaaggacgaaactcacccatgggaggccgaattctccttgggatgaagaaatttctctttccctgtcatgagtgtccagccagggagcagggaggcagtgtcagggagggactctcatcctggaggaaatgggattccaagtcaaggatgctgaggctgtcagggagccagagaggggggtccaagtgcgggatgtgggtggctctgtggttcagtggctctgtggtagttcctagcactgcagacttcatgactccccacttaagtccaagtcacattgtctatcccagtgtgtagctctgtcaccctgcttgacacatccagtggcctacagcgactcttctctaaccccaccccctccaagctgggttctttgtggaagaaggacagggagctagagccaagccctaggcttgagagacacctgcatctataatccccgccaaggatgcccactcacctctctcatctgatcctcactctttgtggaagggaaagctcaaagggactctctctctctctctctttttttttttttttgagtagtacccttgccctcttcatggccacttcaaagtgaagccagcaaagtgataatactttatcatttagtattatcataaagtattaatactttgtcataaagtcctccttgagcccagggaccatggaagtcagctagaagagccctgagcaaggagcaaggacttgggcttctccacgctttgctcctggcttgtttgaccttgactcattccccatatgtctttgaggaggctcacaaaatactaaagctgggaggaaacttggagatctataggtcaaacctccccattgggctgatgagaaaatacacgcaggcctagcatggtgcctgccaccatggtgggatccagtatgttttataaatctgaatgagtaaatggctcaccaatttatgcatagccctgcacatgagcagaatgtgacactcaaagcatccatgcagtacgcatgtaaccttgcacaggagtggggctctggtgaccgaaggttgtccaggactcttgcaggagaagcaatggagtcagtgtggtgtggggagacctactttttaacctgggcttagccacctgctctgtgatccagggcttaccttctttgggcctcggcctcctaatctgggtaatggggaggacttcattggcattgttagtcccacaggccaaggataaggttgaaatgagacggcttgtgtgtgaaaagattttggaaattacacagatgtgggcttgttattgggatgaagactgctggaagggactccttgctgtttatctactgctttgagccctcctaagttaacctgtgcctcatttgtaaaaccaccagcatcaggagtaagggggaggccagagggctcagatggacacagaattctagctttacctgcatccgctgattcagttttctgttgggatcagagtgaggatacttccatatgggtgatagcagccatgcccctgggagtcaacttcaaggatctgggacattttggtgtgcccattccttcttttcctgaactcacagtcttggggtgtttctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttttc

SEQ ID NO: 1260 - DNA, 2395 bp, Homo sapiens
acacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttaacaaatttaagcccgcgagtccccaagaaagcccgagaggaccccctgcctgtgccctcagaccagcattcactccctttcctcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaacagccccccatcatctgattttgggtgtgacccctcgagtgtgcatgccaccctggggctcttctcagtcctgggcccaagtccctgaagcctagcagagggccagctcgggtggccagaacaccccttggtgcaggcctcctggcactcgcctg

SEQ ID NO: 1261 - DNA, 1587 bp, Homo sapiens
cccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctc

SEQ ID NO: 1262 - DNA, 1761 bp, Homo sapiens
gccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttaacaaatttaagcccgcgagtccccaagaaagcccgagaggaccccctgcctgtgccctcagaccagcattcactccctttcctcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaatt

SEQ ID NO: 1263 - DNA, 466 bp, Homo sapiens
atccaggttttctgggcactcgtgtgtcttgcctgtgccaggtgctgtgggcacacgcacgtcagagctgggctcatgctcacttaggagaggctgaagcttaaccagcgtctgcacaaagggaaaggcgctcagtgcagagctactcctctccacaccacaccccctgccggcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctg

SEQ ID NO: 1264 - DNA, 441 bp, Homo sapiens
ggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttaacaaatttaagcccgcgagtccccaagaaagcccgagaggaccccctgcctgtgccctcagaccagcattcactccctttcctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttct

SEQ ID NO: 1265 - DNA, 1889 bp, Homo sapiens
cagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactg

SEQ ID NO: 1266 - DNA, 736 bp, Homo sapiens
gctaagcccccactgccgggggaggcgggtgatgggccggcccagggcctgagaggggaagggcagggtgcacaggagacacggcaggacgggaccatgggctgctgctcctcgagtgacccccgcagagaagacgatctgagagccagagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgct

SEQ ID NO: 1267 - DNA, 757 bp, Homo sapiens
gggagtttcgaggggagcagctctgcagttgtgtggccgctgtttatgtccctcggtgccatcctcactgtcccagcccctccagcgggaacccaggtggatgggagggggctactgcccttctgtgacagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgctgg

SEQ ID NO: 1268 - DNA, 2266 bp, Homo sapiens
gggaacgccggctcccggcatgccgcgcgctgacagccttataaatagtcgcctttgccggccgccgcgaggacgggcagggcacgcactggccccggcgcccacccgcacccctccccagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcccctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgagaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaa

SEQ ID NO: 1269 - DNA, 1021 bp, Homo sapiens
gtgaagagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgta

SEQ ID NO: 1270 - DNA, 3586 bp, Homo sapiens
gtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 1271 - DNA, 647 bp, Homo sapiens
ggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagtgataggacaggcaaagagaagcttcctcaggctagcaaaaatatcatttgatgtattgattaaaaaagcacttgcttga

SEQ ID NO: 1272 - DNA, 1536 bp, Homo sapiens
acacactcttttacgttatttataaaagagtctcactcaatggaagctggatttcctctcctgtaaaatgagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaa

SEQ ID NO: 1273 - DNA, 2736 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaatcataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagtcca

SEQ ID NO: 1274 - DNA, 1171 bp, Homo sapiens
acttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacaggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattc

SEQ ID NO: 1275 - DNA, 2353 bp, Homo sapiens
tattttatgcaattgcacagccacctcatcatttagcaacctccatcctgatcagtcagcagccatcagccatggaggcaagaccctccatcagcaaaaagattaagactctctgaaggctcagatgatcattaacattttttagcaataaaactattttaaattaaggtaggtacattgttattttagacataatgctattgcacttaatagactacaatgtaatgtaaatatataacttttatatgcaccgagaaaccaaaaaatttgtgtgactcacatattcactttattgtggtagtctggaaccaaacccacaatatctccagggtaggcctgtatgtgtctttttgactataaccatgttcgtgaatgtgaagtagtatctccttgtggttttcatttgacttccctaatgattaaggacgttgatcatgtgttcatgggcttattggccatttgtatatcgttgaagaaatgtgtattcagatcctatgcccgtttaacatttttttaaaattgagttgtaagagttctttagatattctagatacaaattccttaccagctacatgatttgcaaaatttttcttccatcccatgctatgcattgtcttttcacttcttttcttttcgtttcttttttaagagatggggtttcaccatgttggccaggctggtctcgaactcctgacctcaggtgatctgcccacctcagcctcccaaagtgctggggttacaggtatgaaccactgttcccggccataacctttgtttttatcagaaaagttgatgatgcacattttcagatgagtatgccattcagacttcccctttaggcaactcgttccgaggtgcctggaatgggataaaacaaatgcacttactgatttttttccccgctttgctgtagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaat

SEQ ID NO: 1276 - DNA, 3929 bp, Homo sapiens
agtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggacacttggagactgagagagaggaggctcgaggaatgaaccttggtctgttctaagccacaacccctgtctcaggtcgtttggcttcctttccttctctttgtatttgaatttaaaaacattcctgaatctcaagtgcttttgcttgaagtaggggggaggaggagaaaagaatagaagcaagccaggcttcctaagcgagctctgaaaggagaaatccattcactgcaaacctcgttccccatttctgaaaacggatagactgatatcgtaaactaaaggtcatgagggtttttccccccggtttgggggatttgttctgttaaaaggaattttaaagcaccacttgagaaaataattttgcctcagtttccctaaactatctttaaaatgggttgccataattacaggtcttcttttctctcacctctataagccaccgttttcaggtcatctgaagtcaagatttccagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaagcaaaaattgatgcaaatacctgatgaagagggcattgttattgatggatttccaagagatgttgcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagac

SEQ ID NO: 1277 - DNA, 3248 bp, Homo sapiens
gcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaagcaaaaattgatgcaaatacctgatgaagagggcattgttattgatggatttccaagagatgttgcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagacagga

SEQ ID NO: 1278 - DNA, 653 bp, Homo sapiens
tgttgctcagtcttcagaccgcagcacagcatcatctgcaccgggacccgggaatggggggacacttggagactgagagagaggaggctcgaggaatgaaccttgagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaa

SEQ ID NO: 1279 - DNA, 1993 bp, Homo sapiens
tttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaaaaaaaaaaaaagaaccaaa

SEQ ID NO: 1280 - DNA, 1779 bp, Homo sapiens
ccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaaaaaaaaaaaaa

SEQ ID NO: 1281 - DNA, 1620 bp, Homo sapiens
cagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactagtctcattctgtcaaggggcgtgatcaaggcttattgcaacctccgcctcccaggctcagacagctctcctgtctcagtctcccaacttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgtta

SEQ ID NO: 1282 - DNA, 1325 bp, Homo sapiens
agtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgtt

SEQ ID NO: 1283 - DNA, 911 bp, Homo sapiens
ttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgtaggcgcctgtgttgtttatacttaaaactcagtctctagaatctatttgtcaattttatttgatgttgtccagttgaggaagtgacactatagatcttttttttttttttgaggcagagtctccctctgtctcccagactggagtgcagtggcacggctcactgcaagctccgcctcctgggttcacaccattctcctgcctcagcctcccgagtagctgggattacaggtgtgagccactgcccctggcctccaaatgctttctttagtcttaaatgaaacataattaaaggcatctttgtgtaactggcgagtcagatagtgggagaagaacagtcttcttacttggaaaatagaaaccttgttgacttgcacattttccagtcattttttcttaattgagaatttttttaatattggagagacagtcttgctgtgttacacagactgatgttgaactcctggcctaagcagtccacctgcttcagcctcccaaaatcctgagaataca

SEQ ID NO: 1284 - DNA, 2780 bp, Homo sapiens
acgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagta

SEQ ID NO: 1285 - DNA, 2399 bp, Homo sapiens
atggcgttcgccgagacctacccggcggcatcctccctgcccaacggcgattgcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 1286 - DNA, 2383 bp, Homo sapiens
cacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcagctccatgtccatccgctggccgggccgccccctcggaagccatgcctggatactgatagccatgtttcagctcgccgtggacctgcccgcctgtgaggccctgggcccggggccggagttctggctcctgccgcggtcgccgccccggccgccccggctgtggagttttaggagtggacagccagcgcgggtcccggccccggtgtggagcccccggccgccccgagtggagcggatccacgggcagatgcagatgcctcgagccagacgggcccacaggccccgggaccaggcggccgccctcgtgcccaaggcaggactggccaagcccccagctgctgccaaatccagcccttccctcgcctcttcgtcctcgtcctcgtcctccgcggtggccggtggggccccggagcagcaggccctcctgaggaggggcaagaggcacctgcagggggacggtctcagcagcttcgactccagaggcagccggcccaccacagagactgagttcatcgcctgggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccaccagtcccagcaacaacggggaagtcacccagcccccaaggattctgggggaggcctcaggtctggctgtccatcagatcatcaccatcaccgtctccctcatcatggtcatagctgctctcatcacaactcttgtcttaaaaaattgctgtgcccaaagcgggaacactcgtcggaacagccaccagcggaagaccaaccagcaggaggagagctgccagaacctcacggacttcccctcggcccgggtgcccagcagcctggacatattcacggcctataacgagaccctgcagtgttctcacgagtgcgtcagggcatctgtgcccgtgtacaccgatgagacgctgcactcgacgacgggggagtacaaatccacatttaatggaaaccgaccctcctcttctgatcggcatcttattcctgtggccttcgtgtctgagaaatggtttgaaatctcctgctgactggccgaagtcttttttacctcctgggggcagggcagacgccgtgtgtctgtttcacggcggttgtccggaatgccagtggctcctgggcagatgtgcaccccagattcagcctttgtgatagattccaacacgttctggcctcagaccacctttgtggtggggccagactgctctgggcaaagtgaagctggcctttatgctccaaggaagggggcctcgagagcaggcctgcattggctctcggactaattcgcgatcatctttcatacagcaggtacacttcagcaaacctcgttaatgttgatctctttccctttgccaaggccgcttcgttctgaacggagcctgcaaagtcataaaagctcttgaatccgaagcaagtgagaaataaatcatgcactattattattttcaaaaacacattgatcactaataaaaaataagaagtgt

SEQ ID NO: 1287 - DNA, 2922 bp, Homo sapiens
tcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcagctccatgtccatccgctggccgggccgccccctcggaagccatgcctggatactgatagccatgtttcagctcgccgtggacctgcccgcctgtgaggccctgggcccggggccggagttctggctcctgccgcggtcgccgccccggccgccccggctgtggagttttaggagtggacagccagcgcgggtcccggccccggtgtggagcccccggccgccccgagtggagcggatccacgggcagatgcagatgcctcgagccagacgggcccacaggccccgggaccaggcggccgccctcgtgcccaaggcaggactggccaagcccccagctgctgccaaatccagcccttccctcgcctcttcgtcctcgtcctcgtcctccgcggtggccggtggggccccggagcagcaggccctcctgaggaggggcaagaggcacctgcagggggacggtctcagcagcttcgactccagaggcagccggcccaccacagagactgagttcatcgcctgggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccaccagtcccagcaacaacggggaagtcacccagcccccaaggattctgggggaggcctcaggtctggctgtccatcagatcatcaccatcaccgtctccctcatcatggtcatagctgctctcatcacaactcttgtcttaaaaaattgctgtgcccaaagcgggaacactcgtcggaacagccaccagcggaagaccaaccagcaggaggagagctgccagaacctcacggacttcccctcggcccgggtgcccagcagcctggacatattcacggcctataacgagaccctgcagtgttctcacgagtgcgtcagggcatctgtgcccgtgtacaccgatgagacgctgcactcgacgacgggggagtacaaatccacatttaatggaaaccgaccctcctcttctgatcggcatcttattcctgtggccttcgtgtctgagaaatggtttgaaatctcctgctgactggccgaagtcttttttacctcctgggggcagggcagacgccgtgtgtctgtttcacggattccgttggtgaacctgtaaaaacaaaacaaacaaaacaaaacaaaaaagacaaaacctaaaactgagctatctaagggggagggtccccgcacctaccacttctgtttgccggtgggaaactcacagagcaggacgctctaggccaaatctatttttgtaaaaatgctcatgcctatgggtgactgccttctcccagagttttctttggagaacagaaagaagaaaggaaagaaaggaaccagaggcagagagacgaggatacccagcgaaagggacgggaggaagcatccgaaacctaggattcgtcctacgattctgaacctgtgccaataataccattatgtgccatgtactgacccgaaaggctcggccgcagagccggggcccagcgaatcacgcagagaaatcttacagaaaacaggggtgggaatctcttccgatagagtcgctatttctggttaatatacatatataaatatataaatacaaacacacacacacactttttttgtactgtagcaatttttgaagatcttaaatgttcctttttaaaaaaaagaattgtgttataggttacaaaatctgatttatttaacatgcttagtatgagcagaataaaccagtgttttctactttggcaactcacgtcacacacatattacacacatgtgcgcattacacacacacaatacacatacatgcatatagacgcatctattggaaatgcagttccacaggtgagcatgttctttctggtgacctggtattccatcaccattcaccccaggggacagcctcgaccgagacaaggaggcccttaaatgacagcctgcatttgctagacggttggtgagtggcatcaaatgtgtgacttactatcttgggccagaactaagaatgccaaggttttatatatgtgtgtgtatatatatatatatatatatatatatatatatatatatgtttgtgtgtgtatatatatatatatatatatatgtttgtgtgtgtatatatatgtttgtgtatatatatacacatatgcatacatatgatttttttttttcatttaagtgttggaagatgctacctaacagccacgttcacatttacgtagctggttgcttacaaacgggcctgagcccctggttgggtgggtggtggattcttggacgtgtgtgtcatacaagcatagactggattaaagaagttttccagttccaaaaattaaaggaatatatcctt

SEQ ID NO: 1288 - DNA, 1959 bp, Homo sapiens
atcacttggctcttctctgatatgaactgggcagcatctaaatgtatctttcttgattttgttgtctctttgcatagagcatatcttgtgaaaacagaaatatccatgtaatggttttttcttgtagtgaccgctcgaaattgcttgagcaacatagagataatgggcaggggtccctgtgtgaagcacctagaggctggaaagctgatggcaaagctggaggggtgaggcagggagaggataaacacagtggaaatgcaggaggaaagctgtgctctgtggtggcctaattacaaggacctgccctacagccagaatcagccagcaaatgcttttgtaaaggaactaaaagaaagggaaaagaggaagtaaacaaaaggtcccttttcagagagggaaccagtgggagatttaagagcaaggaacaacccatttcgtcgttatggtaagtggagattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcatt

SEQ ID NO: 1289 - DNA, 1944 bp, Homo sapiens
ctgtttgcatctctgcaaccacttcagaaggcacgtgtttggtttgctctgagcctaacctagagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcattcctctggcacattatttctaaataagtgttgtttgtggaaatcgtcctatttttatgcctcggttgagggggcaagtaaagtcctggtgaggaatttacagttagaaacttttggaaaaactgaagttcctggaggaaagccaaaccgtgctaacacactagaggctggttttggtcctgggaaaggtttggggtgaatgggttggaagtagggtatgaatac

SEQ ID NO: 1290 - DNA, 574 bp, Homo sapiens
gtagacctaaaaacatctgagagcctagaagtgcacagcagtgtgcagatagattgagaggacttggctctgcaggtggacaacactctatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgt

SEQ ID NO: 1291 - DNA, 951 bp, Homo sapiens
ctgtttgcatctctgcaaccacttcagaaggcacgtgtttggtttgctctgagcctaacctagagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaaagtgg

SEQ ID NO: 1292 - DNA, 2177 bp, Homo sapiens
ctccgcgagagggcctaggattggagggcccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagacacttggcattcaaagatttcaca

SEQ ID NO: 1293 - DNA, 715 bp, Homo sapiens
ggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttgccacggctcatctacctctccatcgtctgtgtcctgggcatttctgccatcattgtggcgcagtgggaccggtttgccactcctaa

SEQ ID NO: 1294 - DNA, 1058 bp, Homo sapiens
atcacgcacttcaggctgcgataacgaggtggagtgtagaatccgacgaacgtcctctaccccggggcgggtggaggttacctggctgcggcggggagtttagaagaccaaactggacaatggactttgctcactatgatgacatgatctccattgacctccatttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaa

SEQ ID NO: 1295 - DNA, 879 bp, Homo sapiens
agggcgctgaagatcggggccgctcggccgcaggccgcctccagcgccgcgggatgtagcgcgggggaccgcggcccccagcagagcccgcctgcccggcttttagaagaccaaactggacaatggactttgctcactatgatgacatgatctccattgacctccatttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaa

SEQ ID NO: 1296 - DNA, 2125 bp, Homo sapiens
atcacgcacttcaggctgcgataacgaggtggagtgtagaatccgacgaacgtcctctaccccggggcgggtggaggttacctggctgcggcggggagtttagaagaccaaactggacaatggactttgctcactatgatgacatgatctccattgacctccatttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagacacttggcattc

SEQ ID NO: 1297 - DNA, 4018 bp, Homo sapiens
gcggcggcggcggtcgctgtcgcggcggcgagagcgcgattccagaagcggcatcgcggcggcggcagcggcggcggctacaccgggcttggccccctccctcctccgttcccccctcctcccccctcccctcagcggtggctcccaagaagtccgagacacgcggatcaactcactatcctgaaggtccattctcccaagaagaggggacagaaagacagatctatttgtaagaaaggcttgggtatcccatgaacgagccaacagaaaaccgattggggtgcagcaggactccagagccagatataaggctcagaaaagggcaccaactggatggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcagataggctggttgatgctgatggccagcctctacatcacaggagctgccctgtatgctgcccggatccccgaacgctttttccctggcaaatgtgacatctggtttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccagtggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggcgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatg

SEQ ID NO: 1298 - DNA, 4562 bp, Homo sapiens
gccatctcctcctcacttccattctgactgcagtctgtggttctgattccataccagaggggctcaggatgctgttgctgggagctgttctactgctattagctctgcccggtcatgaccaggaaaccacgactcaagggcccggagtcctgcttcccctgcccaagggggcctgcacaggttggatggcgggcatcccagggcatccgggccataatggggccccaggccgtgatggcagagatggcacccctggtgagaagggtgagaaaggagatccaggtcttattggtcctaagggagacatcggtgaaaccggagtacccggggctgaaggtccccgaggctttccgggaatccaaggcaggaaaggagaacctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactgatcaccactaactcagagcctcctccaggccaaacagccccaaagtcaattaaaggctttcagtacggttaggaagttgattattatttagttggaggcctttagatattattcattcatttactcattcatttattcattcattcatcgagtaactttaaaaaaatcatatgctatgttcccagtcctggggagcttcacaaacatgaccagataactgactagaaagaagtagttgacagtgctattttgtgcccactgtctctcctgatgctcatatcaatcctataaggcacagggaacaagcattctcctgtttttacagattgtatcctgaggctgagagagttaagtgaatgtctaaggtcacacagtattaagtgacagtgctagaaatcaaacccagagctgtggactttgttcactagactgtgcccttttatagaggtacatgttctctttggagtgttggtaggtgtctgtttcccacctcacctgagagccattgaatttgccttcctcatgaattaaaacctcccccaagcagagcttcctcagagaaagtggttctatgatgacgtcctgtcttggaaggactactactcaatggcccctgcactactctacttcctcttacctatgtcccttctcatgcctttccctccaacggggaaagccaactccatctctaagtgccgaactcatccctgttcctcaaggccacctggccaggagcttctctgatgtgatatccactttttttttttttgagatggagtctcactctgtcacccaggctggagtacagtgacacgacctcggctcactgcagcctccttctcctgggtccaagcaattattgtgcctcagcctcccgagtagctgagacttcaggtgcattccaccacacatggctaatttttgtatttttagtagaaatggggtttcgtcatgttggccaggctggtctcgaactcctggcctaggtgatccacccgcctcgacctcccaaagtgctgggattacaggcatgagccaccatgcccagtcgatatctcactttttattttgccatggatgagagtcctgggtgtgaggaacacctcccaccaggctagaggcaactgcccaggaaggactgtgcttccgtcacctctaaatcccttgcagatccttgataaatgcctcatgaagaccaatctcttgaatcccatatctacccagaattaactccattccagtctctgcatgtaatcagttttatccacagaaacattttcattttaggaaatccctggttttaagtatcaatccttgttcagctggacaatatgaatcttttccactgaagttagggatgactgtgattttcagaacacgtccagaatttttcatcaagaaggtagcttgagcctgaaatgcaaaacccatggaggaattctgaagccattgtctccttgagtaccaacagggtcagggaagactgggcctcctgaatttattattgttctttaagaattacaggttgaggtagttgatggtggtaaacattctctcaggagacaataactccagtgatgttcttcaaagattttagcaaaaacagagtaaatagcattctctatcaatatataaatttaaaaaactatctttttgcttacagttttaaattctgaacaattctctcttatatgtgtattgctaatcattaaggtattattttttccacatataaagctttgtctttttgttgttgttgttgtttttaagatggagtttccctctgttgccaggctagagtgcagtggcatgatctcggcttactgcaacctttgcctcccaggttcaagcgattcttctgcctcagcctcccgagtagctgggaccacaggtgcctaccaccatgccaggctaatttttgtatttttagtaaagacagggtttcaccatattggccaggctggtctcgaactcctgaccttgtgatctgcccgcctccatttttgttgttattttttgagaaagatagatatgaggtttagagagggatgaagaggtgagagtaagccttgtgttagtcagaactctgtgttgtgaatgtcattcacaacagaaaacccaaaatattatgcaaactactgtaagcaagaaaaataaaggaaaaatggaaacatttattcctttgcataatagaaattaccagagttgttctgtctttagataaggtttgaaccaaagctcaaaacaatcaagacccttttctgtatgtccttctgttctgccttccgcagtgtaggctttaccctcaggtgctacacagtatagttctagggtttccctcccgatatcaaaaagactgtggcctgcccagctctcgtatccccaagccacaccatctggctaaatggacatcatgttttctggtgatgcccaaagaggagagaggaagctctctttcccagatgccccagcaagtgtaaccttgcatctcattgctctggctgagttgtgtgcctgtttctgaccaatcactgagtcaggaggatgaaatattcatattgacttaattgcagcttaagttaggggtatgtagaggtattttccctaaagcaaaattgggacactgttatcagaaataggagagtggatgatagatgcaaaataatacctgtccacaacaaactcttaatgctgtgtttgagctttcatgagtttcccagagagacatagctggaaaattcctattgattttctctaaaatttcaacaagtagctaaagtctggctatgctcacagtctcacatctggttggggtgggctccttacagaacacgctttcacagttaccctaaactctctggggcagggttattcctttgtggaaccagaggcacagagagagtcaactgaggccaaaagaggcctgagagaaactgaggtcaagatttcaggattaatggtcctgtgatgctttgaagtacaattgtggatttgtccaattctctttagttctgtcagcttttgcttcatatattttagcgctctattattagatatatacatgtttagtattatgtcttattggtgcatttactctcttatcattatgtaatgtccttctttatctgtgataattttctgtgttctgaagtctactttgtctaaaaataacatacgcactcaacttccttttctttcttccttcctttctttcttccttcctttctttctctctctctctctttccttccttccttcctccttttctttctctctctctctctctctctttttttgacagactctcgttctgtggccctggctggagttcagtggtgtgatcttggctcactgctacctctaccatgagcaattctcctgcctcagcctcccaagtagctggaactacaggctcatgccactgcgcccagctaatttttgtatttttcgtagagacggggtttcaccacattcgtcaggttggtttcaaactcctgactttgtgatccacccgcctcggcctcccaaagtgctgggattacaggcatgagccatcacacctggtcaactttcttttgattagtgtttttgtggtatatctttttccatcatgttactttaaatatatctatattattgtatttaaaatgtgtttcttacagactgcatgtagttgggtataatttttatccagtctaaaaatatctgtcttttaattggtgtttagacaatttatatttaataaaattgttgaatttaa

SEQ ID NO: 1299 - DNA, 4635 bp, Homo sapiens
aggctgttgaggctgggccatctcctcctcacttccattctgactgcagtctgtggttctgattccataccagagggtaagagcaattctgtgaagttccaggctgggctgacagtgcacatgtggattccagggctcaggatgctgttgctgggagctgttctactgctattagctctgcccggtcatgaccaggaaaccacgactcaagggcccggagtcctgcttcccctgcccaagggggcctgcacaggttggatggcgggcatcccagggcatccgggccataatggggccccaggccgtgatggcagagatggcacccctggtgagaagggtgagaaaggagatccaggtcttattggtcctaagggagacatcggtgaaaccggagtacccggggctgaaggtccccgaggctttccgggaatccaaggcaggaaaggagaacctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactgatcaccactaactcagagcctcctccaggccaaacagccccaaagtcaattaaaggctttcagtacggttaggaagttgattattatttagttggaggcctttagatattattcattcatttactcattcatttattcattcattcatcgagtaactttaaaaaaatcatatgctatgttcccagtcctggggagcttcacaaacatgaccagataactgactagaaagaagtagttgacagtgctattttgtgcccactgtctctcctgatgctcatatcaatcctataaggcacagggaacaagcattctcctgtttttacagattgtatcctgaggctgagagagttaagtgaatgtctaaggtcacacagtattaagtgacagtgctagaaatcaaacccagagctgtggactttgttcactagactgtgcccttttatagaggtacatgttctctttggagtgttggtaggtgtctgtttcccacctcacctgagagccattgaatttgccttcctcatgaattaaaacctcccccaagcagagcttcctcagagaaagtggttctatgatgacgtcctgtcttggaaggactactactcaatggcccctgcactactctacttcctcttacctatgtcccttctcatgcctttccctccaacggggaaagccaactccatctctaagtgccgaactcatccctgttcctcaaggccacctggccaggagcttctctgatgtgatatccactttttttttttttgagatggagtctcactctgtcacccaggctggagtacagtgacacgacctcggctcactgcagcctccttctcctgggtccaagcaattattgtgcctcagcctcccgagtagctgagacttcaggtgcattccaccacacatggctaatttttgtatttttagtagaaatggggtttcgtcatgttggccaggctggtctcgaactcctggcctaggtgatccacccgcctcgacctcccaaagtgctgggattacaggcatgagccaccatgcccagtcgatatctcactttttattttgccatggatgagagtcctgggtgtgaggaacacctcccaccaggctagaggcaactgcccaggaaggactgtgcttccgtcacctctaaatcccttgcagatccttgataaatgcctcatgaagaccaatctcttgaatcccatatctacccagaattaactccattccagtctctgcatgtaatcagttttatccacagaaacattttcattttaggaaatccctggttttaagtatcaatccttgttcagctggacaatatgaatcttttccactgaagttagggatgactgtgattttcagaacacgtccagaatttttcatcaagaaggtagcttgagcctgaaatgcaaaacccatggaggaattctgaagccattgtctccttgagtaccaacagggtcagggaagactgggcctcctgaatttattattgttctttaagaattacaggttgaggtagttgatggtggtaaacattctctcaggagacaataactccagtgatgttcttcaaagattttagcaaaaacagagtaaatagcattctctatcaatatataaatttaaaaaactatctttttgcttacagttttaaattctgaacaattctctcttatatgtgtattgctaatcattaaggtattattttttccacatataaagctttgtctttttgttgttgttgttgtttttaagatggagtttccctctgttgccaggctagagtgcagtggcatgatctcggcttactgcaacctttgcctcccaggttcaagcgattcttctgcctcagcctcccgagtagctgggaccacaggtgcctaccaccatgccaggctaatttttgtatttttagtaaagacagggtttcaccatattggccaggctggtctcgaactcctgaccttgtgatctgcccgcctccatttttgttgttattttttgagaaagatagatatgaggtttagagagggatgaagaggtgagagtaagccttgtgttagtcagaactctgtgttgtgaatgtcattcacaacagaaaacccaaaatattatgcaaactactgtaagcaagaaaaataaaggaaaaatggaaacatttattcctttgcataatagaaattaccagagttgttctgtctttagataaggtttgaaccaaagctcaaaacaatcaagacccttttctgtatgtccttctgttctgccttccgcagtgtaggctttaccctcaggtgctacacagtatagttctagggtttccctcccgatatcaaaaagactgtggcctgcccagctctcgtatccccaagccacaccatctggctaaatggacatcatgttttctggtgatgcccaaagaggagagaggaagctctctttcccagatgccccagcaagtgtaaccttgcatctcattgctctggctgagttgtgtgcctgtttctgaccaatcactgagtcaggaggatgaaatattcatattgacttaattgcagcttaagttaggggtatgtagaggtattttccctaaagcaaaattgggacactgttatcagaaataggagagtggatgatagatgcaaaataatacctgtccacaacaaactcttaatgctgtgtttgagctttcatgagtttcccagagagacatagctggaaaattcctattgattttctctaaaatttcaacaagtagctaaagtctggctatgctcacagtctcacatctggttggggtgggctccttacagaacacgctttcacagttaccctaaactctctggggcagggttattcctttgtggaaccagaggcacagagagagtcaactgaggccaaaagaggcctgagagaaactgaggtcaagatttcaggattaatggtcctgtgatgctttgaagtacaattgtggatttgtccaattctctttagttctgtcagcttttgcttcatatattttagcgctctattattagatatatacatgtttagtattatgtcttattggtgcatttactctcttatcattatgtaatgtccttctttatctgtgataattttctgtgttctgaagtctactttgtctaaaaataacatacgcactcaacttccttttctttcttccttcctttctttcttccttcctttctttctctctctctctctttccttccttccttcctccttttctttctctctctctctctctctctttttttgacagactctcgttctgtggccctggctggagttcagtggtgtgatcttggctcactgctacctctaccatgagcaattctcctgcctcagcctcccaagtagctggaactacaggctcatgccactgcgcccagctaatttttgtatttttcgtagagacggggtttcaccacattcgtcaggttggtttcaaactcctgactttgtgatccacccgcctcggcctcccaaagtgctgggattacaggcatgagccatcacacctggtcaactttcttttgattagtgtttttgtggtatatctttttccatcatgttactttaaatatatctatattattgtatttaaaatgtgtttcttacagactgcatgtagttgggtataatttttatccagtctaaaaatatctgtcttttaattggtgtttagacaatttatatttaataaaattgttgaatttaa

SEQ ID NO: 1300 - DNA, 4599 bp, Homo sapiens
acttccattctgactgcagtctgtggttctgattccataccagaggagacgggatttcaccatgttgtccaggctggtctgaaactcctgacatcagggctcaggatgctgttgctgggagctgttctactgctattagctctgcccggtcatgaccaggaaaccacgactcaagggcccggagtcctgcttcccctgcccaagggggcctgcacaggttggatggcgggcatcccagggcatccgggccataatggggccccaggccgtgatggcagagatggcacccctggtgagaagggtgagaaaggagatccaggtcttattggtcctaagggagacatcggtgaaaccggagtacccggggctgaaggtccccgaggctttccgggaatccaaggcaggaaaggagaacctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactgatcaccactaactcagagcctcctccaggccaaacagccccaaagtcaattaaaggctttcagtacggttaggaagttgattattatttagttggaggcctttagatattattcattcatttactcattcatttattcattcattcatcgagtaactttaaaaaaatcatatgctatgttcccagtcctggggagcttcacaaacatgaccagataactgactagaaagaagtagttgacagtgctattttgtgcccactgtctctcctgatgctcatatcaatcctataaggcacagggaacaagcattctcctgtttttacagattgtatcctgaggctgagagagttaagtgaatgtctaaggtcacacagtattaagtgacagtgctagaaatcaaacccagagctgtggactttgttcactagactgtgcccttttatagaggtacatgttctctttggagtgttggtaggtgtctgtttcccacctcacctgagagccattgaatttgccttcctcatgaattaaaacctcccccaagcagagcttcctcagagaaagtggttctatgatgacgtcctgtcttggaaggactactactcaatggcccctgcactactctacttcctcttacctatgtcccttctcatgcctttccctccaacggggaaagccaactccatctctaagtgccgaactcatccctgttcctcaaggccacctggccaggagcttctctgatgtgatatccactttttttttttttgagatggagtctcactctgtcacccaggctggagtacagtgacacgacctcggctcactgcagcctccttctcctgggtccaagcaattattgtgcctcagcctcccgagtagctgagacttcaggtgcattccaccacacatggctaatttttgtatttttagtagaaatggggtttcgtcatgttggccaggctggtctcgaactcctggcctaggtgatccacccgcctcgacctcccaaagtgctgggattacaggcatgagccaccatgcccagtcgatatctcactttttattttgccatggatgagagtcctgggtgtgaggaacacctcccaccaggctagaggcaactgcccaggaaggactgtgcttccgtcacctctaaatcccttgcagatccttgataaatgcctcatgaagaccaatctcttgaatcccatatctacccagaattaactccattccagtctctgcatgtaatcagttttatccacagaaacattttcattttaggaaatccctggttttaagtatcaatccttgttcagctggacaatatgaatcttttccactgaagttagggatgactgtgattttcagaacacgtccagaatttttcatcaagaaggtagcttgagcctgaaatgcaaaacccatggaggaattctgaagccattgtctccttgagtaccaacagggtcagggaagactgggcctcctgaatttattattgttctttaagaattacaggttgaggtagttgatggtggtaaacattctctcaggagacaataactccagtgatgttcttcaaagattttagcaaaaacagagtaaatagcattctctatcaatatataaatttaaaaaactatctttttgcttacagttttaaattctgaacaattctctcttatatgtgtattgctaatcattaaggtattattttttccacatataaagctttgtctttttgttgttgttgttgtttttaagatggagtttccctctgttgccaggctagagtgcagtggcatgatctcggcttactgcaacctttgcctcccaggttcaagcgattcttctgcctcagcctcccgagtagctgggaccacaggtgcctaccaccatgccaggctaatttttgtatttttagtaaagacagggtttcaccatattggccaggctggtctcgaactcctgaccttgtgatctgcccgcctccatttttgttgttattttttgagaaagatagatatgaggtttagagagggatgaagaggtgagagtaagccttgtgttagtcagaactctgtgttgtgaatgtcattcacaacagaaaacccaaaatattatgcaaactactgtaagcaagaaaaataaaggaaaaatggaaacatttattcctttgcataatagaaattaccagagttgttctgtctttagataaggtttgaaccaaagctcaaaacaatcaagacccttttctgtatgtccttctgttctgccttccgcagtgtaggctttaccctcaggtgctacacagtatagttctagggtttccctcccgatatcaaaaagactgtggcctgcccagctctcgtatccccaagccacaccatctggctaaatggacatcatgttttctggtgatgcccaaagaggagagaggaagctctctttcccagatgccccagcaagtgtaaccttgcatctcattgctctggctgagttgtgtgcctgtttctgaccaatcactgagtcaggaggatgaaatattcatattgacttaattgcagcttaagttaggggtatgtagaggtattttccctaaagcaaaattgggacactgttatcagaaataggagagtggatgatagatgcaaaataatacctgtccacaacaaactcttaatgctgtgtttgagctttcatgagtttcccagagagacatagctggaaaattcctattgattttctctaaaatttcaacaagtagctaaagtctggctatgctcacagtctcacatctggttggggtgggctccttacagaacacgctttcacagttaccctaaactctctggggcagggttattcctttgtggaaccagaggcacagagagagtcaactgaggccaaaagaggcctgagagaaactgaggtcaagatttcaggattaatggtcctgtgatgctttgaagtacaattgtggatttgtccaattctctttagttctgtcagcttttgcttcatatattttagcgctctattattagatatatacatgtttagtattatgtcttattggtgcatttactctcttatcattatgtaatgtccttctttatctgtgataattttctgtgttctgaagtctactttgtctaaaaataacatacgcactcaacttccttttctttcttccttcctttctttcttccttcctttctttctctctctctctctttccttccttccttcctccttttctttctctctctctctctctctctttttttgacagactctcgttctgtggccctggctggagttcagtggtgtgatcttggctcactgctacctctaccatgagcaattctcctgcctcagcctcccaagtagctggaactacaggctcatgccactgcgcccagctaatttttgtatttttcgtagagacggggtttcaccacattcgtcaggttggtttcaaactcctgactttgtgatccacccgcctcggcctcccaaagtgctgggattacaggcatgagccatcacacctggtcaactttcttttgattagtgtttttgtggtatatctttttccatcatgttactttaaatatatctatattattgtatttaaaatgtgtttcttacagactgcatgtagttgggtataatttttatccagtctaaaaatatctgtcttttaattggtgtttagacaatttatatttaataaaattgttgaatttaa

SEQ ID NO: 1301 - DNA, 2557 bp, Homo sapiens
gtagcgcttgtgtcgacatcggcgcgcgccgagcccggaagaggcgcgggctaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcatcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 1302 - DNA, 1090 bp, Homo sapiens
cagcattctgcattcaaggaatgatctggaagaagccttcattcacttcatggggaagggagcagctgctgagcgcttcttcagtgataaggaaacttttcacgacattgcccaggttgcatcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaa

SEQ ID NO: 1303 - DNA, 1650 bp, Homo sapiens
gttcgcgcaggtgcggcgcctgggtccccatggcgctgtggcgcggctccgcgtacgcgggcttcctggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcatcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagttcttccttgcccacttgagaagtgcacgcccactcacccaacatcctggtctctaggaaagcctcatgtgaggttcctctttctttcagtctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttc

SEQ ID NO: 1304 - DNA, 808 bp, Homo sapiens
atggctgcaagctgcagggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaact

SEQ ID NO: 1305 - DNA, 1885 bp, Homo sapiens
ccttacccggcgtgccccgcgcccggaggcgctgacgtggccgccgtcagagccgccatcttgtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 1306 - DNA, 1972 bp, Homo sapiens
ccttacccggcgtgccccgcgcccggaggcgctgacgtggccgccgtcagagccgccatcttgtgggagcaaaaccaacgcctggctcggagcagcagcctctgaggtgagggcgaggggcgcgggccggtgtgggccgcagagacgttggagccggcgggggctggggactggcctcggggcgacttgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttc

SEQ ID NO: 1307 - DNA, 2006 bp, Homo sapiens
gcccgcgcgtggacggttgggattagcggccgcgggggccggtgggggtcgtggggcctcccccacccgagtacaggcgagcgagcggcatccgggcggacccccgcctcggggaccgggaaactgaggctcgggcggcctgagacgccgtcaaggtcatgtaggtggtgggggcttgcatcttcgcctcccgactccatccagttcgtgtttgctgtgaagacggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttc

SEQ ID NO: 1308 - DNA, 1796 bp, Homo sapiens
gtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 1309 - DNA, 4105 bp, Homo sapiens
accgcgcagctatcgcgcgatcggggaggtgggaagtatcccgggctgggggtgggggtacgccgcacagctccagtcgccgtcgcggcttccggtgctaggtggagggaaggaaggagggagccggggagtgggccagggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcagctttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtc

SEQ ID NO: 1310 - DNA, 1089 bp, Homo sapiens
agtcgccgtcgcggcttccggtgctaggtggagggaaggaaggagggagccggggagtgggccagggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttg

SEQ ID NO: 1311 - DNA, 576 bp, Homo sapiens
agagggagcggagcggaacctgcggggcagaggcggcggccgcagcggcgcagctgatagcaggaacagttttattgggaggagatctgctgcaagagtctgattgcttgggtcagtgcaacaggacagaatctagtcgctgcatacctccttccctgtcctcaatcagaacctgtgggctctgaggacatggaaaccatttcttcagtttgtcagatacagggaaaaggatcagagaccacctatagaatacagtcttcttcaaccccacaagtgttttgccaccctcagtagaaccgttctcaacacgcctgtcagtcactagctataggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggtt

SEQ ID NO: 1312 - DNA, 485 bp, Homo sapiens
gctcaagggggcgacctgggctgcagttaggttgtcgcctgcaggaggtgtgctgttgagggagaggaaaaccgtccgaggagaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgagg

SEQ ID NO: 1313 - DNA, 807 bp, Homo sapiens
gggaaggaaggagggagccggggagtgggccagggcagcagccgggctgaagtcggcttggggagccagagggagcggagcggaacctgcggggcagaggcggcggccgcagcggcgcagctgatagcaggaacagaagtctcagggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaag

SEQ ID NO: 1314 - DNA, 557 bp, Homo sapiens
aaaacgggccacttgattagcaaagtggtagctgttattttgggggaattcccgtcttgattgcattaaggcgggtctccatctttccaggccaggaggaatgtggtggtggaggtggaggattgtggtatgtggtcaggagtgagaagaaatagtaaggccgtcccggtgagggagaaatgtaacctaaaacctgtctctgctgttgttggattgggtcacccctggtctatggcatgaaagttttattgggaggagatctgctgcaagagtctgattgcttgggtcagtgcaacaggacagaatctagtcgctgcatacctccttccctgtcctcaatcaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcgggg

SEQ ID NO: 1315 - DNA, 1660 bp, Homo sapiens
gccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 1316 - DNA, 641 bp, Homo sapiens
gcgcaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaa

SEQ ID NO: 1317 - DNA, 732 bp, Homo sapiens
ctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcgtaccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatgg

SEQ ID NO: 1318 - DNA, 1103 bp, Homo sapiens
acgggggcgggcccgcggtgacgtcgggagggcagcgacgcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacacgg

SEQ ID NO: 1319 - DNA, 2776 bp, Homo sapiens
cggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaagttttggggtcacaagcagcagccggagccggcgtccgagctgggccacagcctgaacgagaacgtcctcaagcctgcgcaggagaaggtgaaggagggaaagatttttgatgatgtctccagtggggtctctcagttggcgtccaagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgt

SEQ ID NO: 1320 - DNA, 3467 bp, Homo sapiens
gggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaagtgccagcgccgtctttgctgccatcagtcccactgctctgcgggccatttggggcgtgcattttgtcctgtttcctggcatgaggcgctctgcggacagacggggagggaagagcaggcctcgctcctcccccccaagcatgtggtgggagctcttgaggtctgtgcacgaggctgtcctcgctgccatgtcccgcacacacctggcaccgctgcagagtggccggggcgtctgtgtctgtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatg

SEQ ID NO: 1321 - DNA, 3278 bp, Homo sapiens
gtgagaccttgcaaagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgca

SEQ ID NO: 1322 - DNA, 1548 bp, Homo sapiens
agctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataagagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgt

SEQ ID NO: 1323 - DNA, 1311 bp, Homo sapiens
ggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaagttttggggtcacaagcagcagccggagccggcgtccgagctgggccacagcctgaacgagaacgtcctcaagcctgcgcaggagaaggtgaaggagggaaagatttttgatgatgtctccagtggggtctctcagttggcgtccaagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcg

SEQ ID NO: 1324 - DNA, 995 bp, Homo sapiens
acccgcaccccggatctggaatctcccaccggttacgggagtccagagggtccctgcccacgcacgtcgcctcccggggcgcgagcaggaccctgccccgtccgcttcaacacccttttcccgagctccttcggacccaggactcggcctggacacatcccagtcaggtggcctctgaagcccggtggggcttccaccccctaagaacatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagg

SEQ ID NO: 1325 - DNA, 579 bp, Homo sapiens
gcaaagcgcaacgtagccggaagctggtggcggctggtgggcgaccgggcgcatcctcattgcagtgcggcggccctacctcggccctggcctgaccccggcggccctgcccgcccctccctccagtcggctgtataggtggatgctcagtttgatgacggtatccgcctgaatgagtcatgctgggggtccaagtcctgcggtcaggagtgagcattcagatgtctgcctcatgatctgtggttcctggacactcttacagaaggcacagaattatggagcagaagggagcccagggtgaacttttggttttgttttgatgaactgcagaaaacagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtggga

SEQ ID NO: 1326 - DNA, 572 bp, Homo sapiens
cttttcccgagctccttcggacccaggactcggcctggacacatcccagtcaggtggcctctgaagcccggtggggcttccaccccctaagaagtgagggtcctaagaaggagatatatttttacatcttggtttcaagcgttcagagtttttgcgttatttttcaagataaactatatttgtacttttgaaggttaggagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagag

SEQ ID NO: 1327 - DNA, 1306 bp, Homo sapiens
gtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcagctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactga

SEQ ID NO: 1328 - DNA, 1565 bp, Homo sapiens
gaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttc

SEQ ID NO: 1329 - DNA, 2369 bp, Homo sapiens
gcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttgggatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaagcag

SEQ ID NO: 1330 - DNA, 2976 bp, Homo sapiens
cccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttgggatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaa

SEQ ID NO: 1331 - DNA, 2857 bp, Homo sapiens
gggccagcggcgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcagatggcattgcctacatttttccctgaaa

SEQ ID NO: 1332 - DNA, 1640 bp, Homo sapiens
ctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcagtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacacc

SEQ ID NO: 1333 - DNA, 1650 bp, Homo sapiens
ttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcactgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgta

SEQ ID NO: 1334 - DNA, 817 bp, Homo sapiens
tctcgccttgtttcaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagca

SEQ ID NO: 1335 - DNA, 542 bp, Homo sapiens
ctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcagtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggc

SEQ ID NO: 1336 - DNA, 7225 bp, Homo sapiens
gcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatcaaaacctgtataa

SEQ ID NO: 1337 - DNA, 8852 bp, Homo sapiens
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacagaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtggataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagta

SEQ ID NO: 1338 - DNA, 2651 bp, Homo sapiens
ggcggcgccgtggggccgaggtgtcgcttcctgacggggcggcgcggacggacgcggccggtgccggccgggacgccgggcccgcagcctagctcgccatctcgctcacgccgcccgcccgcggggccgtcagcccccgccgggccggggccatgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaataaaaaaaaattaa

SEQ ID NO: 1339 - DNA, 3760 bp, Homo sapiens
cacccaagtctgagttgctaaaaaatggagctgtcactgggccttgctctgccaggacctgcagagccggggacctctctgtggcaagcccagcaagatgactgctctgaggcgccctagggctgagggaggggccgtgacaccagccccgccccccagccacctgggaaaaggaagcacaaaaaggagaagcagcaacggctgctctgcttccttcccatctcgctcttgggtcatgcctggccagcagaaagcagctccataggggaggagagccacgcaggatctcacagctgcagtctaatagtaacacagaggattcagcagtggccaccatgggttctgtgaattccagaggtcacaaggcggaagcccaggtggtgatgatgggcctggactcggcgggcaagaccacgctcctttacaagctgaagggccaccagctggtggagaccctgcccactgttggtttcaacgtggagcctctgaaagctcctgggcacgtgtcactgactctctgggacgttggggggcaggccccgctcagagccagctggaaggactatctggaaggcacagatatcctcgtgtacgtgctggacagcacagatgaagcccgcttacccgagtcggcggctgagctcacagaagtcctgaacgaccccaacatggctggcgtccccttcttggtgctggccaacaagcaggaggcacctgatgcacttccgctgcttaagatcagaaacaggctgagtctagagagattccaggaccactgctgggagctccggggctgcagtgccctcactggggaggggctgcccgaggccctgcagagcctgtggagcctcctgaaatctcgcagctgcatgtgtctgcaggcgagagcccatggggctgagcgcggagacagcaagagatcttgatccagacagagcagcatatctttgctcatacaaactagaagaaccagctgatccttgagaaatttacgcttagtctatcaaacaagaaatgctggcttggcccggtggctcatgcctgtaatcccagcactgtgggagaccacggtgggggaatcccttgagcccaggagttggagagcaacatcacaacaccccatttctactaataatcaaaaaattggccgggcatggtggcatgtgcctgtagtcccagctacttgggaggctgaggcaggagaatcgcttgagcccaagaggtagaggttgcagtgagccaagatcgcgccactgcactccagtctgggcaacagagtgagaccctgtctcaataataataataataataatgatgatactctaagaaaaaaatctcaacatacttcatttaatagctcgttaccaagtgtgaatgaagcaatatgtcataatagagtagccactggttgcataataatagagacctaaattctcaaatagggaaagaggttttaaaatcaaatttgaggccaggtgcagtggctcatgggcggaggagggcagattacttgaggctaggagttcaagaccagcctggccaacatggtgaaaccccatctctactgaaaatacaaaaattaggcatagtggtgcacgcctgcagtcccagctactcaggaggttgaggcagaagaatcgcttgaacccaggaagtggaggttgcagtgagccgagattgtgctgctgcactccagcctgggtgaaaaagacaggctgtgtctccaaaaagaaaaaaaaaagtcaaattcaaatatcatctggacatgtcacaatggatcgcggatccttatgagtgattttccccagtggcccctggggatgtgccactgtcactcagaagggcaagctaggcagggcccatacaacagcaggggtctgcaggttagacgttccctgccctgggacgctcacccctgggcaagaggctggaagttcacaccatccaaaatttatccttgttttttttctgatgctaattagcctctcccgattttatgacatcttgtgttgatctttttcaaaaactcattttcttttttttccttctcttttctccttcttgtagcacatatctttcgttaaagatcagatcaataaaatattttatttattcattaatttaacaaaaaaaacagagcatttagtttgtggcaaaaacactgagctttcgaatatgaatcatgtgctttaggtgggaattgtgaattctgaagatacagatgacagtgacgaatgccttctgtctcatgattgacagggaaaaggaaggttgaccatagcatcctagaaggctcatcaggtgatcattacctagcatccatgaagcacctgaaattatttgcaaaatgttacgctttggaccatttttccggggaaggagatccagaactttttaccagattttcaaagacatctgtgactcccaaaagttaacaatcactgatgtggttgttgtatccctcatccaaccccagaacactttctgtaatctgagttttttaatggcaagtggcctatatttagcacctgttctcatgttaaacagctctgaatgttagatattctttcttatcctggactggttctctctatctctggagtaatgcagtataaattggccatcagtaccctcctaaaatctgagatctgccaggcccctcttctaacaccaggttaggcatgcttggttatttccagtacttgtcagtcaacatgtttcaagacgctgtgttagacactagggatgcaaagatgaatgagataaggcctcaggcctcatggaaggtgagacagtaaagacattactcccataaaaatgtgaggagagagactcagttcagcaactgtttattctgtttattgagcacttacttggaccaagcactgtggtcttggtgttttacatagactgtctctaattctcacaactctgcaaaatatatatattcccattttataaaactacaaactgaggctcagagaaggtgtgacctcttgttgcttgaggcacagagttataaagtaacatatctggaatttgaaatcagatctgtttagggctaatgctgcatttttctacaacatcatgcctctagaaggtttaagctaggtaggctttcagccagcagacatgatggggagagccttctaataagagggaagagactgcttggaagcatgaagggaggtgtaagaaagataagtaagtcagtgtacttgcaacagaggcttgggatgaagggtgggtgaagttgacatcacgatagaaaacaaaactggaatgggagtttaggtccaatttgggcaaggttgtttgaatttcaataatcaggggtttgggtcaaggaagaaaaatcatgggacttgccatttaggaggataattttgtggtagtgtggaggtgaaataaagagaaaagggaaccttggagctgggaaggcaggaaaccggctagatgaccatcacacagcaaaggagggagtggaagagagatgagaaaattgagagctattattaagaaaaacagttgagagaggaagaatttgaagagggctcaagattttgagtccacatgacagaaggactggaatgccatgaactggagaaggtgagcgctgaagaaccaggatgggacggggctggaacagctgggttcagcttttgcagggtgggtacgtgtttggttatagctgctttcagattgttccattatctgtactcccaacaaccctgccggatatatttgttggctttcactc

SEQ ID NO: 1340 - DNA, 3264 bp, Homo sapiens
acgtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcaggttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgcagtgactcttttaggtgattctaattctttcatgccttgaaattaaactatgaaattaaaggcagaaaaactggaaaacctactgcaggtccagagacttctgttttacaactgggaaacagcttgtgtactaaagtaatgagaataaaaatgttggcccaaaattacttttataaataaataattccaaaataatttcttaatttaaaatgatagcacttctcttgcacttaagaatggcatccataagattctgtatttggcatttagactaacttctagatgtatatttttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttaaaaattgtacttcagaacatcagattttattcacattttttaactcactgaactttaataatcaggtcacctgtactctagtcagcactgtatatattcttggagtttgtacatgggacttagcaaccacactgagtgaggtaaaagcatttgatttcagatctaaaattcgtaacaacctaaatttgagaggtggctgaaatgtgatgaaaagcaatacgaaaagacaatgtaaactttgaaaaggattttagagggaaaattgcatagctttttgtaacatttacttaattttaaaactaaactcatacttttgctatctttttaatatttatctcgtttgggagtatacgtgtttttaaaatttgtgttttctatctgtttactatagtgtagctactggcttcatttaataaaaataaatgattttgaaattaaatataatatagaattcacattttatatagctctctcaaaaattaatttttattccttaagcattttaaaaacattttaaaaaatgttttgtaaatccaggtgtattttaacaattaaatgcctattttgttatatgttatacttttattcttaattctgaattttgacattttcacacaataaaaataatttatatcaa

SEQ ID NO: 1341 - DNA, 2453 bp, Homo sapiens
cgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgca

SEQ ID NO: 1342 - DNA, 2206 bp, Homo sapiens
gcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaa

SEQ ID NO: 1343 - DNA, 3906 bp, Homo sapiens
agcacgtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgcagtgactcttttaggtgattctaattctttcatgccttgaaattaaactatgaaattaaaggcagaaaaactggaaaacctactgcaggtccagagacttctgttttacaactgggaaacagcttgtgtactaaagtaatgagaataaaaatgttggcccaaaattacttttataaataaataattccaaaataatttcttaatttaaaatgatagcacttctcttgcacttaagaatggcatccataagattctgtatttggcatttagactaacttctagatgtatatttttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttaaaaattgtacttcagaacatcagattttattcacattttttaactcactgaactttaataatcaggtcacctgtactctagtcagcactgtatatattcttggagtttgtacatgggacttagcaaccacactgagtgaggtaaaagcatttgatttcagatctaaaattcgtaacaacctaaatttgagaggtggctgaaatgtgatgaaaagcaatacgaaaagacaatgtaaactttgaaaaggattttagagggaaaattgcatagctttttgtaacatttacttaattttaaaactaaactcatacttttgctatctttttaatatttatctcgtttgggagtatacgtgtttttaaaatttgtgttttctatctgtttactatagtgtagctactggcttcatttaataaaaataaatgattttgaaattaaatataatatagaattcacattttatatagctctctcaaaaattaatttttattccttaagcattttaaaaacattttaaaaaatgttttgtaaatccaggtgtattttaacaattaaatgcctattttgttatatgttatacttttattcttaattctgaattttgacattttcacacaataaaaataatttatatcaatattctgtttctcttttcaattggtagatttaaatgatttcctttgggtaataaaataggtaaagattttaaaatatgattattgaaaaacagtttaaatcagtagattaaaataatgcatttttttgatactttacacacaaaacttttttctctctgcaagtttttatgtatgtgggaaagaatttgtgattttaaatgcagctacaaatagcatttcaccatatgatgttagaggatttgatgtctgtcttgcgttaaagctgttggtcaacagatatgtttttatgtatttaaaagaggctcttgtgtgcctttatgtgtaaaatgcatattacgtagtatacatgatattgtatgtaactgacttcaaatataaaactatgcat

SEQ ID NO: 1344 - DNA, 1615 bp, Homo sapiens
gcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggaggttggcaaataaacaagataaagaaggagctttaggagaagctgatgtcattgaatgtctatctctggaaaaattggtcaatgagcacaagtgcctgtgtcagatagtaaggaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaacttt

SEQ ID NO: 1345 - DNA, 1286 bp, Homo sapiens
gataagctacaacataaacacatctaggttcttgttcttagaatacagcatgaagaatttgctttcttctttcttcctaacattttcatgtgagatccagaaaggacacattgtctctggccattcgaagaaagaaagaaagaaaaaaaaaaaaggtatttagagacagagagagaaaaaggctgaaatgggttcgctgggttctaaaaatccgcaaaccaaacaagcccaagttcttcttttgggacttgactcagctgggaagtctactctcctttataaattaaagcttgctaaggatattaccaccatccctacaataggtttcaatgtggaaatgatcgagttggaaaggaatctttcactcacagtctgggatgttggaggacaggaaaaaatgagaactgtttggggctgttactgtgagaacaccgatgggctggtgtatgttgtggacagtacagacaaacagcgactggaagagtctcagagacagtttgagcacattttgaagaatgaacacattaaaaatgtgcctgttgttctattagccaacaaacaagacatgcctggagctctgactgctgaggacatcaccagaatgttcaaagtgaagaagctttgcagtgaccggaactggtatgtgcaaccctgctgtgccctcacaggggaggggctggcccaggggttcaggaaattaactggatttgtgaagagccacatgaaatcaagaggagacactttggcgttcttcaagcagaactgaggctgcgaaaaatccaagtctctacagagacactgatgaagttgaaagggtaattgtttttccatgccaaatgaggaaatcaaattaatgagttgacaaacttttcctgagatgttatttcatctacatttagttaaacaacttagaatgatatctagaaaatatttattttcagccaggaactttagcaaactgtggcaatgatcactgggaatgaaaacgtataatgttctacaatttttgttatcacattggatgactttgaatatagtagtgacacttgggaccaaataaattattttatatgactactagaacaaagttttagtaagctgtctgctaatagagtcagaattcttccagattgtttccagctgtaacaggtattgaatttccaccgtgctcctatgtaacagctgggtggtgtaaaaaatgaacttcaaattatggagtggaaaaagcgtaatgttaatatcttgtaaattcgtattccctattaaataaagctttcttattccct

SEQ ID NO: 1346 - DNA, 979 bp, Homo sapiens
gactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1347 - DNA, 830 bp, Homo sapiens
cggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1348 - DNA, 795 bp, Homo sapiens
gggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgt

SEQ ID NO: 1349 - DNA, 1017 bp, Homo sapiens
accccgccccgtattgctgctcagctcctcagctgtgcgtgcgagggacgtcgggggcggcgccgcagcagttgcccctggtaacgggggaggcagcaggaggaggaggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggctttttttt

SEQ ID NO: 1350 - DNA, 1584 bp, Homo sapiens
ggctctgcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagct

SEQ ID NO: 1351 - DNA, 1390 bp, Homo sapiens
gcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagaaaaactgcctgctcttctaaattgtgtgtcccaaaatatttcattaacaagtatcaagtgataatccatggaaaagtgatggaaagtcacaatacaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaagttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaat

SEQ ID NO: 1352 - DNA, 1350 bp, Homo sapiens
gcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagatacagttgtcttggaagcctgttattgataaagttgctgcagcctcacatccttcaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaagttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaat

SEQ ID NO: 1353 - DNA, 894 bp, Homo sapiens
gctacgccgggaactgcccggctcctcgcaggaaataggcagctcaccctgccacctgtgcacacatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagatacagttgtcttggaagcctgttattgataaagttgctgcagcctcacatccttcaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgt

SEQ ID NO: 1354 - DNA, 1518 bp, Homo sapiens
atgatgctacgccgggaactgcccggctcctcgcaggaaataggcagctcaccctgccacctgtgcacacatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaagttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaatataa

SEQ ID NO: 1355 - DNA, 1705 bp, Homo sapiens
aactcccatgatgctacgccgggaactgcccggctcctcgcaggaaataggcagctcaccctgccacctgtgcacacatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagaaaaactgcctgctcttctaaattgtgtgtcccaaaatatttcattaacaagtatcaagtgataatccatggaaaagtgatggaaagtcacaatacaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggttgctataacaaagtaccatagactgggtggcttataaacgacagaaatttatttcttacagctctggagctggaagtctgagatcagattaccagcatggttgggttctggtgagagccgtcttggttgcagactgccatcttcttgtatcctcacatggccaaaagaggacaagagaactctctggagtctgtttgataagagcatgaatcccattacatcttcacatggctcctcccaaagaccccacctcctaatatcatcacatgtcatcacatagggggttagaatttcaacatagaaattttgggagaacacaaacattcagtcagttgcaatacttaaggcaaattcatcttgcttataactctggtgcatgtgcattaaaatactattgcattgtaa

SEQ ID NO: 1356 - DNA, 836 bp, Homo sapiens
ctatttgtctttaataatcctgggtaatagtcaactaataatcctgggtagtagtctggagacactcctagcggagtttactcgggagagggcggagaaatacatgacatgagcagtacaggctcatggttgggagctgagggaaggctgagaatcctcccggaacctctggattctgacgccccaggggttcttcacacaggctggccggtctcgggattgaagccggagacgtcagacgctaaggttgcttagactgcggcccacgtggaaggctcttagccaccctgcctggcccgaggagaaaaacaagcaaatcctagtgctgggcctggatggagcaggaaaaaccagtgtcctgcactctctagcttcaaacagagtccagcacagtgtggcacccacccaaggtttccatgcagtttgcatcaacactgaagacagccagatggagttcctggagattggtggcagtaaaccttttcggtcctactgggaaatgtacctatccaagggattgctgctgatctttgtggtggattcagcagatcacagccgattacctgaagccaagaaataccttcatcagctaattgcagcaaacccagtacttcctctggttgtgtttgcaaacaaacaggatcttgaagcagcctatcacattacagatatccatgaagctttggcattatctgaagtgggaaatgacaggaagatgttcttgtttggaacctacctgactaagaatggctcagagataccctccaccatgcaagatgccaaagacttgattgcacagctggctgcagatgtgcagtgaccaggactcagcccac

SEQ ID NO: 1357 - DNA, 1644 bp, Homo sapiens
ctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 1358 - DNA, 1339 bp, Homo sapiens
ggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctg

SEQ ID NO: 1359 - DNA, 1354 bp, Homo sapiens
ctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 1360 - DNA, 1587 bp, Homo sapiens
ctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 1361 - DNA, 2101 bp, Homo sapiens
cgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 1362 - DNA, 2060 bp, Homo sapiens
cgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 1363 - DNA, 1872 bp, Homo sapiens
ggcacgagagcagactctgaaccaggaagtagccgtgtctagcgctctacaagacacataggagaggtggcatccatggccctgaaacgacaagcccatgttgccagcgcattatcaccaagtcacttggcaagcgtttagcagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcgagaatattttccgtcctccaccatcaacattgacactgcgtagatttgccgcacttggacctccatgcgtggcactcacccgcagtctcctggacaggcgctgtattttattctgtcgcagagctaatgctgtttactcactcacttcaacaacactaactgcggtggtggcctccagcaggcccccccgctgcagaccctctgtcctgcctctgcctccaggcatgcgtttccccgtgagggccaatgcacctccccccaccccccaccctcccatgtccacagtgggtcgtgtgttcctggacagagaaacagtccacactggggcctgcgggacacatatagcagcatattttgctcttaaccccacccacctttttaatcacactagattttaagatcaatccctttttgaaacaactcacggagaaaaccagaacataaatggcctcctgccagctccggcgtctctctgtggtctgccttagtgggccaagtccaaatgcagagaaggcctttcccttccgcgcctgccccatcgggctcgctgacgaggaagcgctgtccctgtgatgaggttctctctcagagagtcttggaaaagagaccacttgctcttgtttaaaataaatttggacgtgatttttccatgcagcatctggtgtgaataaaacagcagttgactgat

SEQ ID NO: 1364 - DNA, 1341 bp, Homo sapiens
tgaccactataaaagtcaggcgggctgaggaggagacaaaggccaggacgctccgcagctgttggggaagaggagctgcctcctgggatggagaaatttaaggctgcgatgttgctggggagcgtcggcgatgctcttggctacagaaatgtctgcaaggagaacagcactgtaggcatgaagatccaggaggagctgcaacgttccgggggcctggaccacctcgtactctcgccaggagaatggcccgtgagtgacaacaccatcatgcacatcgcaaccgccgaggccctcaccacagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcg

SEQ ID NO: 1365 - DNA, 950 bp, Homo sapiens
cctccttccgggtgagcctctgaacagggctgtctccttctgggtgagcctctctgaaccgggctgcctccttccgggtgtgtctctctgaacggggctcactccttccagggtccctccttcccggtgagcctctctgactggggctgcctccttccgggtgagcctctctgactggggctgcctccttccgggtgagcctctctgactggggctgcctccttccgggtgagcctctctgaacagggcacgagagcagactctgaaccaggaagtagccgtgtctagcgctctacaagacacataggagaggtggcatccatggccctgaaacgacaagcccatgttgccagcgcattatcaccaagtcacttggcaagcgtttagcagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaag

SEQ ID NO: 1366 - DNA, 1668 bp, Homo sapiens
caccggaagtggcgagcagtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacagaagccttgtactacacagatgacacagccatggccagggccctggtgcagtccctgctagccaaggaggcctttgacgaggtggacatggctcacagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccagctgatctaggtcacacctggctcttggctgccatgtggcttattaacagcttccagtggaagtcgcaataaacagtttttggtaaatctca

SEQ ID NO: 1367 - DNA, 1425 bp, Homo sapiens
agcagtctgcgcgcggatggccgcagcggcgatggcggcagcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacagaagccttgtactacacagatgacacagccatggccagggccctggtgcagtccctgctagccaaggaggcctttgacgaggtggacatggctcacagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcat

SEQ ID NO: 1368 - DNA, 1279 bp, Homo sapiens
agtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacagaagccttgtactacacagatgacacagccatggccagggccctggtgcagtccctgctagccaaggaggcctttgacgaggtggacatggctcacagatttgctcaggagtacaagaaagaccctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagcc

SEQ ID NO: 1369 - DNA, 1312 bp, Homo sapiens
ggccatggtggagatcagcagcagcttccccacccaggacaaggcctagatgaggaaactgagacccaaaaagagacagcaactggcccagggtcaccagcatgcagatgcctgctatgatgtctctgcttcttgtgtctgtgggcctcatggaagcacttcaggcccagagccaccccatcacacgacgagacctcttctctcaagagattcagctggacatggccctggcctcctttgatgaccagtacgctggctgtgctgctgccatgacagctgctctcccggatctcaaccacacggagttccaggccaaccaggtgtatgcagacagctggacactggcaagcagccaatggcaggagcgtcaggccaggtggccagagtggagtctcagccccacccgtccatccccgccacccctgggcttccgcgatgagcatggggtggccctcctggcctacacagccaacagccccctgcacaaggagttcaatgcagccgtgcgtgaggcgggccgctcccgggcccactacctccaccacttctccttcaagacactccatttcctgctgactgaggccctgcagctcctgggcagcggccagcgtccaccccggtgccaccaggtgttccgaggtgtgcacggcctgcgcttccggccagcagggccccgggccaccgtgaggctggggggctttgcttctgcctccctgaagcatgttgcagcccagcagtttggtgaggacaccttcttcggcatctggacctgccttggggcccctatcaagggctactccttcttccctggagaggaagaggtgctgatccccccctttgagaccttccaagtgatcaatgccagcagactggcccagggccccgcccgcatctacctccgagccctgggcaagcacagcacctacaactgcgagtacatcaaagacaagaagtgcaagtctgggccttgccatctggataattcagccatgggtcagagccccctctctgcagtctggtctttgctgctgctgctctggttcctcgtggtgagggcctttccagatggtccaggcctcctttgatgcatgagacacgggacagcctcgcctgctgcctctgcccatcctgaggatgttggccatgtgtgctttcagtgtaaccaagattcctgtcaatcccatctgcagggaactctgggaccttctctggtagctgccagaccggctggtggagaaacaggagacaatctggggactgaaccttacccagggctgtaggagtgagactctgaataaagggttgggccggc

SEQ ID NO: 1370 - DNA, 1517 bp, Homo sapiens
agtgaggaggttatacccggaggtctcgacgctcgctcgtgctgctcgtgttgccgctgggtacgtttgctgccagtgctgatccagccggaggcgaagagaagcactttgggggcaaaagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttcagaattgcca

SEQ ID NO: 1371 - DNA, 1528 bp, Homo sapiens
ctcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatattt

SEQ ID NO: 1372 - DNA, 1561 bp, Homo sapiens
ctcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatattt

SEQ ID NO: 1373 - DNA, 545 bp, Homo sapiens
aaatgctaatgtaaccccaaagaactttacaaagcggaattcttagttttcacaagtgtggcccagcctccctcttgaatctttttggttgtggaatcgaggtgttctgtttaattatccagtgtgactgactctgtggcagggacgaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatat

SEQ ID NO: 1374 - DNA, 560 bp, Homo sapiens
ttcttgttcccgccttcagaaagttataagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggct

SEQ ID NO: 1375 - DNA, 801 bp, Homo sapiens
gttgccgctgggtacgtttgctgccagtgctgatccagccggaggcgaagagaagcactttgggggcaaaagaatcttctgatggcatgctaacaattgtagatggcaactgtgttggaaactaggggatcccatctgagttggtcaaagtctgccaaaaagaaaaaagaaaaccaatatttaagagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatc

SEQ ID NO: 1376 - DNA, 502 bp, Homo sapiens
ttccagaaccttcttcagtgaggaggttatacccggaggtctcgacgctcgctcgtgctgctcgtgttgccgctgggtacgtttgctgccagtgctgatccagccggaggcgaagagaagcactttgggggcaaaaggccaaaaagaaaaaagaaaaccaatatttaagagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagc

SEQ ID NO: 1377 - DNA, 5129 bp, Homo sapiens
gctttttcctgtttggctgggaaagggaaggctgaactgctgagtctgacacttaacaggacttcggcattcccctgaatacagactagatcagagattttatttttttaattgaaaagtaacttgggttctctttagaaacccttatttggtgtgcgcatctggctatttcacagagatttcagttttgcaaagaagtcggagttgatttcttccctcagacaagctattggttgttggtgggcaacagaagttgctcagcatagacaggggaaaaaacggttacggatgagactgaaagaaaacctcaaaggagaactctgagaattcatctcaggatgaagctgcaagggcaaaggagaagtacttgtgacacaagcaaatgggtccattgatcaacagatgcaagaagattcttctcccaactactgtacctcctgcaacgatgagaatctggctccttggaggcctgctgccattcctgctgctcctctctggcctgcagagacccacagagggttctgaggttgcaattaaaatcgacttcgacttcgcaccaggttcttttgatgatcagtaccaaggctgtagcaaacaggttatggagaaactaactcaaggggattatttcacaaaagacatagaagcccagaagaattattttaggatgtggcaaaaagcccacttagcctggcttaaccaaggaaaagttctaccccagaacatgactaccacacacgctgtggctattttgttttatacattgaacagcaatgttcattctgactttactagagccatggcctctgttgccaggactccacagcagtatgaacgttcattccacttcaaatatttacactactacctcacctcagcaatccagctgctgaggaaagacagcatcatggagaatggcactctgtgctatgaggtgcattataggacgaaggatgtccactttaatgcctacacaggggccaccattcgatttggccaattcctctccacatccctcctgaaagaagaggcacaggagtttgggaaccagacactatttaccatattcacctgcctgggtgcacctgtacagtacttctccctcaagaaggaagtcttgatccctccctatgagctgtttaaagttataaatatgagctaccacccaagaggagactggttgcagttgaggtcaactgggaacctgagcacatataactgtcagctgctaaaagcttccagcaagaaatgcatccctgatcctatagctattgcatctctctcctttttgaccagtgtcatcatcttttccaaaagcagagtataaagaaatcttgtggctccttttatttaaaaaaaatatttaaataaaatcttttttattggccttttggctagaaatggacatttattttccaggaaggatgatcccatcatacttctgctgaaaccagtgcatggcctcctctttgctaattctcttatgcctttccttgtacccctttgccttatttcaatctgggcaccctaagtactcttggggaaatcactctgcccagctagcaactgatgcagagctggctcagcccactgactgtgattggcctgtaactcaggccttagccaatcagtatatttcttcttcatggacacaaagattcatgctggaatagaaaatgatccaatcagagcctgtgagatacaatcagggtacttttgtggaattgcaattggaaatagaatgggagcttcttttctgaatggatattaatgaaagcagggtaggagcttatagctgccagcaaagatcccgccaccaggagaggagaccccatctccttgagaaaggatctaacacaacaaaggaagagctgataagtgaaaagaaactgagacctgatgagaatgtataagcctctggatccaactttgcctaaagctgaatactacaagatttttcattacataaatcaataatttatgtttttgcttgcataatttgaattagattttctatgtcaagcatcaagcagttgaagttccaacgaatacaagcactcttccttattttttttaatttagttattctaaataggaacaaatcaaagaagattaaattagaaagcaaaggacaaattcttcaccaaacagaaaagctttgaaccccagagattaaccaaggtgtgaattttcttcagagattttttatgagcattcaagattaagctagtatggcctcagatgagaagacacatggaaacttgagaaataaaagggaaagttaatgaaagatgttagtgaaatttcattcaccagcagtaatgggtgttcatgcatgttcctaagacattacaaaagttaaaatttaaactcatatgttaattcatagagaacttgatggcaaatttaagtcttcatagcaaatttaaatattaggaaaacatgagggtatgtgtgaaggttaacagagagtatgagagaaaaaaacactgattacaaacaaatatcagcaatatagcgaggtctcattacatgtaaactagtacatgcaaagaagtataaattgttgaattgtatagctggaaatgtcctctaacgcttccctcaggtagtaatttaggtagcgacataagggattatttaacccgatcacgatcactgaagaccctggtatcaggctaaatggagtaaagatgagggctagctctataattttggattttgaaagtccatgctccttatcccttttaagatttggataagaaacagcaaaactgaaaatcggtccatctatttactctccataggacttcctgaatggcctgtgtcatgatcaaagaaatggaatggggaataagctacataaaattacctggcagggagttcaggcatctctgtactatcattctttaaattgggatttgaaactaacagggccaaatcacctctgtcacctagttgcagtagcctctacagtcaataaaggaaagaatttctgccaggcatggtggctcacccctgtaatcccagcactttgggaggccgaggaggacggatcacgaggtcaggagttcaagaccagcctggccagcatggtgaaaccccgtctctactacaaatacaaaaattagccaggcatggtggcacgcacctgtaatcccagctacttgggaggctgaggcaggaaaattgcctaaacccaggaggcggaggtagtgcagtgagccaagttcacaccactgcactccagcctgggcaacagagtgagactcgatctcaaaaaaagaaaaaaagaaagaatttctacaaacagacaatttatgtgacttgcataggatagggtctttggcagtttggtggctacctagtagagagtcctggggacatggctctgggagcaagcttttccagtgagcatcgatgagtcagtaatgacatgctatgttggtaaaagccacccaacatcttaagtacatttttcctgtgccatataaatgcatgtattgagccatactgtgtacaaagcactttggggattaaaagttaagaacactaggccagatctctcatgagtttacaatctcttaggagaaattaagaacataaagcaagccacaagtgaaatgccaaaaaaaaaaaaggcaaaaatcaagttttctgttcataacaattcaaaagaaagatttcttccaactgaggcaagaagagacacccggaaggctttaagtaagaggctgcatttgaaccagccgttagggctctaggctgggagaaggggtgagcagaaggagaaaaaaacaagaaagagtatgtgccaagtgcgtagtgcccaaaacaaggccaaatattaaatgcttggagctgagagaaaaatgtgattcctctggcctatggttagataaagctttctatcagagatgatgttttacttagaggaaagcagaaaatagaagcgaatacggaatgatcgatgtatgtacagcataaggtcagggagcagataggtctggcagagagtgaggggtaatgtgggctggagaggaaattggaagccactcagtgaagctaaaaagtcagccaaaagcatttgatttccatgagaagtcataattttctgagtaagacaattctcctaaagcgttgactctctaggcacaagcagcaatagcatcctttaagaactcattagaaatgtgaattttagggcctgatcccagactacagactacagaaattgaacagtctgttttaataagtcctctagatgattctgctatacaccaacatttgagaacactgtgacttacacaattatgatccttaagggaatagccaagtttctaaaaaagataacttagttctaactcctgctgctgttttacagatcaaatctctggagacagaaactattctcttaaaattatgtagattcatgagtttggttaaggataaatgtacatagctcacatcccctcagtctctccctatagtccaaagttgttgagcaaggaatctgtagagtattgatttaaattgattaagttacatgtttatgaaactctaagagactagttttagaaatttcactgtaatttctgctgggataaatttgttagcctgggatatcttccaaagataaggcggatgctcaaatatgtgtaaattcatgcaactgttaacagagactgtgctgtaaggagtacttatgtcctatagtaattttattaaacaaatacatgtatgtctccttttgatgtgtacagaaatatactgtttaatctgaagaagctgattgaaacaggaaaaatttaaaaagtaaaaacactcaacccatgtaatactttatttttataacaaggtgttctctttaatacgcctattagattatcctgaagttctctatttactcttactttaaaaaaaatccaatgaaagaaaatttcagtaaagtttgttttgctagaagaatcaggattcttgtactgagttgtctaataatatgaatcaaattgatttacactgaatgaactagctcttgatttggtaaaattcaacaagcatttattaggtgctttcagaaataccaagatgcagcaaacactggcaactaataaaaaaaattacaagta

SEQ ID NO: 1378 - DNA, 393 bp, Homo sapiens
tacggatgagactgaaagaaaacctcaaaggagaactctgagaattcatctcaggatgaagctgcaagggcaaaggagaagtacttgtgacacaagcaaatgggtccattgatcaacagatgcaagaagattcttctcccaactactgtacctcctgcaacgatgagaatctggctccttggaggcctgctgccattcctgctgctcctctctggcctgcagagacccacagagggttctgagcttccagcaagaaatgcatccctgatcctatagctattgcatctctctcctttttgaccagtgtcatcatcttttccaaaagcagagtataaagaaatcttgtggctccttttatttaaaaaaaatatttaaataaaatcttttttattg

SEQ ID NO: 1379 - DNA, 1241 bp, Homo sapiens
gtcgggttaccagcgcgggggctacagttagcctcgagaacctttgctttcagccggactccggactcctccggggacagcgcagcgcccgccagagccctcggcgctccctcccgctggcggcttccgcagccttcaaggatggcgctggcggctttgatgatcgccctcggcagcctcggcctccacacctggcaggcccaggctgttcccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggagactctgtccgcttgggccagtttgcctccagctccctggataaggcagtggcccacagatttggtaatgccaccctcttctctctaacaacttgctttggggcccctatacaggccttctctgtctttcccaaggagcgcgaggtgctgattcccccccatgaagtctttttggttaccagattctctcaggatggagcccagagcttggtgactctctggagctataatcagacctgtagccattttaactgcgcctatctgggtggggagaagaggcggggctgtgtgtctgcgccaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtg

SEQ ID NO: 1380 - DNA, 1154 bp, Homo sapiens
aatcctggacccgggatcccgtgcgcctggagacagggtccagatctgcctccagcccctcgaaaccaggactccagcacctctggtcccgccctcacccggacccctggccctcacgtctcctccagggatggcgctggcggctttgatgatcgccctcggcagcctcggcctccacacctggcaggcccaggctgttcccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggagactctgtccgcttgggccagtttgcctccagctccctggataaggcagtggcccacagatttggggagaagaggcggggctgtgtgtctgcgccaggggtgcagctagggtcacaatctgagggggcctcctctctgcccccctggaagactctgctcttggcccctggagagttccagctctcaggggttgggccctgaaagtccaacatctgccacttaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtgga

SEQ ID NO: 1381 - DNA, 1504 bp, Homo sapiens
cggactcctccggggacagcgcagcgcccgccagagccctcggcgctccctcccgctggcggcttccgcagccttcaagtgggtcctccgcccccggccctcccctctcaggcggagccaaactgcggccccgcctttacagtctcggaaaggtccccagactggaggctctgaggaaggggtgtggggagtcgggggcggagacttggggcggggggcgggcaataaactcccaggccccgcccacgccccgccggggccctaatcctggacccgggatcccgtgcgcctggagacagggtccagatctgcctccagcccctcgaaaccaggactccagcacctctggtcccgccctcacccggacccctggccctcacgtctcctccagggatggcgctggcggctttgatgatcgccctcggcagcctcggcctccacacctggcaggcccaggctgttcccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggagactctgtccgcttgggccagtttgcctccagctccctggataaggcagtggcccacagatttggtaatgccaccctcttctctctaacaacttgctttggggcccctatacaggccttctctgtctttcccaaggagcgcgaggtgctgattcccccccatgaagtctttttggttaccagattctctcaggatggagcccagagcttggtgactctctggagctataatcagacctgtagccattttaactgcgcctatctgggtggggagaagaggcggggctgtgtgtctgcgccaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtggagacatggaa

SEQ ID NO: 1382 - DNA, 2281 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatggggtgggtggtagacccaactcatcaggcagcgggtagggcacagggaagagggagggtgtctcacaaccaaccagttcagaatgatacggaacagcatttccctgcagctaatgctttcttggtcactctgtgcccacttcaacgaaaaccaccatgggaaacagaatttcatgcacaatccaaaagactataaatataggattatgatttcatcatgaatattttgagcacacactctaagtttggagctatttcttgatggaagtgaggggattttattttcaggctcaacctactgacagccacatttgacatttatg

SEQ ID NO: 1383 - DNA, 1765 bp, Homo sapiens
tcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggaggggaatggattgtagatatttcaccaagaattgcagagagcatatcaagcatgtgaattttatgatgccaccgtggagaaagggttcagaatgctgatctccaggtagctggagacctaggcagtctgcaaatgaggagtcagctggaagctatggctatgtattatgtgacatcgcttgttcctaagtgaaaactggatatcccaaccttctggcccagtaggtttcatggttaagacctggtagtgagaacattttaggaactatttgcttgggcaggcaatttttcactct

SEQ ID NO: 1384 - DNA, 1411 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggacatacattcttaaatatgacgtgctgttttggagaaaagggctgtcggtctgcactaggctgcgggagaggaaagagattaaaaactga

SEQ ID NO: 1385 - DNA, 1697 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgatgaggaaactgaggcccaagaaggaaaaaatgactcacccagctttaaacaaccagttcaccatgcagcagtgctggggttggaggtgatggagaaggaaaatttggaaggtgtttcaaggaaagacacctgtggggtttggtgaccagttggaatgtaagaggcaaaaaaaagggagaaggaactagatacatattcttctggcaggaactgttaattgggttcctgctcccatcttgcactacagtgagagagataacctggtctcctaccattggaaagcatatcatctgtgctctggaggatgagacaatcaaagaaaacaagtaaataagaaaacttaaaaactgtgatatgtaccgtgaaataaataagcc

SEQ ID NO: 1386 - DNA, 2548 bp, Homo sapiens
acgtcagcgagagctgcaaagttccttgctattcttttctggtgtcggggagctgaatattaaaagggtgattgtggagttaccggttatctgcatttttttttcttttcttattttgactctttttaaaaaatgcaggtaaagtgacagcggttcaggagcttaaagacatcagtggtggaggggtgagtcagcgggtgcaaaaggacaaggatttggtgcctcggagacacggtcccctctccgcctccagagaagagcaggcaggcagctcccgggaccgaagccgggtccacatcccccgcgcgcgagctggtggctcagcagcggcgcttcaggtggacgcggtcaaacgatgccccgcagcctcctgggtctcagcacatattccacacctacgtcccctgacctgtgctcctagaagctggagagagcaggagccttcggtggggcagctcaaaatgtaggtaactgcgggccaggagcagcgcccaacctgtagcgctgcgctacccaaccatcggtccctgcctttgagcgtcgacggctgatcttttggtttgagggagagactggcgctggagttttgaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatgg

SEQ ID NO: 1387 - DNA, 1555 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaa

SEQ ID NO: 1388 - DNA, 2089 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaaggaatgatcatgaatgcaaagggaaagaggaaaagagccttcagggacaaatagctcgattttttgtaaatcagtttcatacaacctccctcccccatttcattcttaaaagttaattgagaatcatcagccacgtgtagggtgtgag

SEQ ID NO: 1389 - DNA, 2304 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggacgaagtctcgctctgtcaccaggctggagtgcagtggcatgatcttggctcactgcaacctccgcctcccgggttcaagagattctcctgcctcagcctcccaagcagctgggactacagggatgtgccaccaggccgacgccaccaggcccagctaatttttgtatttttagtagagacggggtttcaccatgttggccaggatgatctcgatctcttgacctcatgatctgcctgcctcagcctcccaaagtgctgggattacaggcgtgagccaccgtgcccggcccaactattttttttttttatcttttttaacagtgcaatcctttctgtggatgaaatcttgctcagaagctcaatatgcaaaagaaagaaaaacagcagggctggacggatgttgggagtggggtaagaccccaaccactcagaaccacccccccaacacacacacacattctctccatggtgactggtgaggggcctctagagggtacatagtacaccatggagcacggtttaagcaccactggactacacattcttctgtggcagttatcttaccttcccatagacacccagcccatagccattggtt

SEQ ID NO: 1390 - DNA, 1918 bp, Homo sapiens
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgacgaagtctcgctctgtcaccaggctggagtgcagtggcatgatcttggctcactgcaacctccgcctcccgggttcaagagattctcctgcctcagcctcccaagcagctgggactacagggatgtgccaccaggccgacgccaccaggcccagctaatttttgtatttttagtagagacggggtttcaccatgttggccaggatgatctcgatctcttgacctcatgatctgcctgcctcagcctcccaaagtgctgggattacaggcgtgagccaccgtgcccggcccaactattttttttttttatcttttttaacagtgcaatcctttctgtggatgaaatcttgctcagaagctcaatatgcaaaagaaagaaaaacagcagggctggacggatgttgggagtggggtaagaccccaaccactcagaaccacccccccaacacacacacacattctctccatggtgactggtgaggggcctctagagggtacatagtacaccatggagcacggtttaagcaccactggactacacattcttctgtggcagttatcttaccttcccatagacacccagcccatagccattggtt

SEQ ID NO: 1391 - DNA, 1838 bp, Homo sapiens
tgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggtcttctggattttgagaagcagctgcaaggatgaacggattggtgttggcccaaattaaaaagaagagtattcagttctttcagtgtttggagaaagaagaccaaaagcatcatctcacagggagcagaatgtgaccagcctggctaatgaggaaatgagagggatcctcaacttgagaacccgctctactgaagtctgaacttggaaaaatggacacattgggtttggagtaagaattcttactctacaaaaggataaaattgtgatcacattgatgcatgatgcctaggatattaaaaatgcatgattaattaaatgttagtctaccttgtgttttaaagggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacagg

SEQ ID NO: 1392 - DNA, 1738 bp, Homo sapiens
gccaggagggcgcctctgggaagaagaccacgggggaagcaaagtttcagggcagctgaggagccttcgccgcagcccttccgagcccaatcatccccctggctatggagggcggactctaagatgaatcccgacctggacaccggccacaacacatcagcacctgcccactggggagagttgaaaaatgccaacttcactggccccaaccagacctcgagcaactccacactgccccagctggacatcaccagggccatctctgtgggcctggtgctgggcgccttcatcctctttgccatcgtgggcaacatcctagtcatcttgtctgtggcctgcaaccggcacctgcggacgcccaccaactacttcattgtcaacctggccatggccgacctgctgttgagcttcaccgtcctgcccttctcagcggccctagaggtgctcggctactgggtgctggggcggatcttctgtgacatctgggcagccgtggatgtcctgtgctgcacagcgtccattctgagcctgtgcgccatctccatcgatcgctacatcggggtgcgctactctctgcagtatcccacgctggtcacccggaggaaggccatcttggcgctgctcagtgtctgggtcttgtccaccgtcatctccatcgggcctctccttgggtggaaggagccggcacccaacgatgacaaggagtgcggggtcaccgaagaacccttctatgccctcttctcctctctgggctccttctacatccctctggcggtcattctagtcatgtactgccgtgtctatatagtggccaagagaaccaccaagaacctagaggcaggagtcatgaaggagatgtccaactccaaggagctgaccctgaggatccattccaagaactttcacgaggacacccttagcagtaccaaggccaagggccacaaccccaggagttccatagctgtcaaactttttaagttctccagggaaaagaaagcagctaagacgttgggcattgtggtcggtatgttcatcttgtgctggctacccttcttcatcgctctaccgcttggctccttgttctccaccctgaagccccccgacgccgtgttcaaggtggtgttctggctgggctacttcaacagctgcctcaaccccatcatctacccatgctccagcaaggagttcaagcgcgctttcgtgcgcatcctcgggtgccagtgccgcggccgcggccgccgccgacgccgccgccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttagggcccccgtgcgcagctttctttccctggggaggaaaacatcgtggggggga

SEQ ID NO: 1393 - DNA, 2677 bp, Homo sapiens
ccgacgggacccgtgcgcggagctgcatctggagccccgcggctatgccctgtgctcccctccctgccggccgctcgttctgtgccccggcccggccaccgacggccgcgcgttgagatgactttccgcgatctcctgagcgtcagtttcgagggaccccgcccggacagcagcgcagggggctccagcgcgggcggcggcgggggcagcgcgggcggcgcggccccctcggagggcccggcggtgggcggcgtgccggggggcgcgggcggcggcggcggcgtggtgggcgcaggcagcggcgaggacaaccggagctccgcgggggagccggggagcgcgggcgcgggcggcgacgtgaatggcacggcggccgtcgggggactggtggtgagcgcgcagggcgtgggcgtgggcgtcttcctggcagccttcatccttatggccgtggcaggtaacctgcttgtcatcctctcagtggcctgcaaccgccacctgcagaccgtcaccaactatttcatcgtgaacctggccgtggccgacctgctgctgagcgccaccgtactgcccttctcggccaccatggaggttctgggcttctgggcctttggccgcgccttctgcgacgtatgggccgccgtggacgtgctgtgctgcacggcctccatcctcagcctctgcaccatctccgtggaccggtacgtgggcgtgcgccactcactcaagtacccagccatcatgaccgagcgcaaggcggccgccatcctggccctgctctgggtcgtagccctggtggtgtccgtagggcccctgctgggctggaaggagcccgtgccccctgacgagcgcttctgcggtatcaccgaggaggcgggctacgctgtcttctcctccgtgtgctccttctacctgcccatggcggtcatcgtggtcatgtactgccgcgtgtacgtggtcgcgcgcagcaccacgcgcagcctcgaggcgggcgtcaagcgcgagcgaggcaaggcctccgaggtggtgctgcgcatccactgtcgcggcgcggccacgggcgccgacggggcgcacggcatgcgcagcgccaagggccacaccttccgcagctcgctctccgtgcgcctgctcaagttctcccgtgagaagaaagcggccaagactctggccatcgtcgtgggtgtcttcgtgctctgctggttccctttcttctttgtcctgccgctcggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccctcctcttctgggaaataggcacagaagctttggccggctaccccagtgcctcccttagggaaaaagtcagtgggaccagggctcctcagtggacaaatttctccttcttactgccaactggaggaacccagtggacctaccaccacccacaagctttggtggcagattgtatagccgtcatacaagcctgctgtatttatccatgggcccgctgtccgccacccaggctcctccgtgcacaccccatcacctggcccctaccccttattacttcccctcaagggccttactgtttacactctgtacatagctcatcgtgcctgtgcccatcacttcttgctgggattccaagccaccaattggagagctttatttgtcattttgagacatatttattggtaagagtacttctattttgtccaagctgtgcaaactgtccctctttagcccataacccattaaaaaaaaaatactttttcccctaaa

SEQ ID NO: 1394 - DNA, 3278 bp, Homo sapiens
aggggcgacgctcttgtctagccgagccgggcagcgctgtcgtccacggtgcgcactgggcgggcagcgctccctctgcccacctcccgccccgtcatggaccaccaggacccctactccgtgcaggccacagcggccatagcggcggccatcaccttcctcattctctttaccatcttcggcaacgctctggtcatcctggctgtgttgaccagccgctcgctgcgcgcccctcagaacctgttcctggtgtcgctggccgccgccgacatcctggtggccacgctcatcatccctttctcgctggccaacgagctgctgggctactggtacttccggcgcacgtggtgcgaggtgtacctggcgctcgacgtgctcttctgcacctcgtccatcgtgcacctgtgcgccatcagcctggaccgctactgggccgtgagccgcgcgctggagtacaactccaagcgcaccccgcgccgcatcaagtgcatcatcctcactgtgtggctcatcgccgccgtcatctcgctgccgcccctcatctacaagggcgaccagggcccccagccgcgcgggcgcccccagtgcaagctcaaccaggaggcctggtacatcctggcctccagcatcggatctttctttgctccttgcctcatcatgatccttgtctacctgcgcatctacctgatcgccaaacgcagcaaccgcagaggtcccagggccaagggggggcctgggcagggtgagtccaagcagccccgacccgaccatggtggggctttggcctcagccaaactgccagccctggcctctgtggcttctgccagagaggtcaacggacactcgaagtccactggggagaaggaggagggggagacccctgaagatactgggacccgggccttgccacccagttgggctgcccttcccaactcaggccagggccagaaggagggtgtttgtggggcatctccagaggatgaagctgaagaggaggaggaggaggaggaagagtgtgaaccccaggcagtgccagtgtctccggcctcagcttgcagccccccgctgcagcagccacagggctcccgggtgctggccaccctacgtggccaggtgctcctgggcaggggcgtgggtgctataggtgggcagtggtggcgtcgacgggcgcagctgacccgggagaagcgcttcaccttcgtgctggctgtggtcattggcgtttttgtgctctgctggttccccttcttcttcagctacagcctgggagccatctgcccgaagcactgcaaggtgccccatggcctcttccagttcttcttctggatcggctactgcaacagctcactgaaccctgttatctacaccatcttcaaccaggacttccgccgtgccttccggaggatcctgtgccgcccgtggacccagacggcctggtgagcccgcctgcgctgcccctgtggggttggtgcggtggcgccggggtcaccctgcttcttgccctgctgtgtgtggctgcctcccctgggctttctgctccctgcccagatcctgtaggcctcatcttaggaaccccttgggaggggtgggcaggggggctgctagcaagggtcccagtgaagcttccccttgccggcttagctgtgggggaccccttctccaccctctccctgagcacaggccgatggaggtggttcaaatcctctggaacatagccaagaccaggagaagagagagcactttcttcccagagccccatgctctccagaccaatgtctgggcttccctttcttgaggaccttgtgttcctggcaggtcacttgcttgtggtgttttcgtttctttttcatctcccccccacccacaaagagcacggagccagccttccacttttcccagtggggcctgctgctgagggggaggaagaaacgaagactgatcacccacgctaggcactcgcggtccctggcaggcgctgggatgggggcttatggggtggcatcgtctctgggccctcctttccccctttgcctgttttcggatctgtggttcctttgaaagccagaacaatggatcggcttccttacccagcacccctccggtaggtgggtggccacgtggatgcctcgctggggcggtcttggaggcctggtctctgcctcgacgggagatccccgatcactggcattcaccccctgcaaaaatcggggcgacaatagctcactgcctacttgctgcagggagatgaaaggctttgcagaaagctttgagctctgtgggggaacacactagagaaccaaaaatgtgattatatggtgatataaaaatccctttcctctgtgtttaccaccacctgtcttcctgtagacttttgttctgtccctggggtgtgtgaattcctaccccgaactggaagccgggagtggcagacagaatcactatttcaagttaaaggatctctttgagaatgtgttcttctggctgcaaaggtctgagttattacgctacatgacaacgtttcgacatttcaccggcaacaccaagagggtttttagtggcttgggtctccccagtgggggataagtcttttgtcatcaaggaggcaaattgtctccccaagacagctcaaaatatccacacctcggcaacagtctaagatgagagcctgtgacaggtggcagcgcccccaggtggggtactggcatcagagcctggtgcgcccctaggggagcctcccactggagtgcccggccaggtctccaagccccaaatgagtccttgtgaaccacaactgatccccccaggtgggtgcttgtggactgcctcggacccagccacgctgctccccgcaatgctgatggggctgtgcattgaggacccctgcttcctggttctcagtcccaccccaaaacctggcacccagaacagttggaagtgtggaaaggaggtttatcggccttcccttggagagggcctggcttcaacattgggccagtaggcatcttagcttggcaggtgtcgggggaatgggccagatggacctgctagatttggaagggcaccgagggagttttctgggtgtagagagaatggaggggaccaaaaagagtccttcctggggtgtgggaggcttcccagcttggtcctcagtgggttgttgaggccagagtatcgccctgggatgtggtggggagctgggccaggagagggactgactgtgaccctctgctggccggtcttgtgtgcgccccatgggacccccagtgttcttgcctgtg

SEQ ID NO: 1395 - DNA, 2127 bp, Homo sapiens
gcagctgcggggagcccggcagccacgctctccggcgcgccgcccgcggagccaccacggccgagggccggctgctgggcgccgcggtccccggcgggcgcgcccgagcagcaggcggcgatgcgggcgccgaccccggctggggggcgcccgagctgccgcggctgcgccccggctccaggagggacggcgtagctcgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacgggggagctttcccagagacccggggatggattggcctccagggcgcaggggagggtgcggcagggcaggagcttggcagagagatagccgggctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatct

SEQ ID NO: 1396 - DNA, 3466 bp, Homo sapiens
ggaggcggcggcggctccggggcgcgggcgcgcgggcggcggcggcggcggcgccccgactgcagtcccggcgggagcggagcgcgagccggggccgggcccgagccggcgccatggggcggcgccgcctgtgagcggcggcgagcggagccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatcctgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 1397 - DNA, 2443 bp, Homo sapiens
ggccggctacagcctgcggcgcgcgcagagcgctagtggggcgcgcggcgcgcgcgcggggcgggggcgcgcggaggggggggctgccccggggcggcccccccaggtcggggcgcggcgggcggcggcggcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaa

SEQ ID NO: 1398 - DNA, 2873 bp, Homo sapiens
ggggcgcgcggaggggggggctgccccggggcggcccccccaggtcggggcgcggcgggcggcggcgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggatgaagaattgatactgaaggtttctatgtggctgacagtcactaaaccaacaagtcacaacttgaacccagcttttctgactctggagtcgggttctgcacagggaaaacaggaagcgctcagagctgtggagaatctgctggtgcacgtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatg

SEQ ID NO: 1399 - DNA, 2862 bp, Homo sapiens
gcaccacgccgcccgggcttctggggtgttccccaaccacggcccagccctgccacaccccccgcccccggcctccgcagctcggcatgggcgcgggggtgctcgtcctgggcgcctccgagcccggtaacctgtcgtcggccgcaccgctccccgacggcgcggccaccgcggcgcggctgctggtgcccgcgtcgccgcccgcctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccgctgggagtacggctccttcttctgcgagctgtggacctcagtggacgtgctgtgcgtgacggccagcatcgagaccctgtgtgtcattgccctggaccgctacctcgccatcacctcgcccttccgctaccagagcctgctgacgcgcgcgcgggcgcggggcctcgtgtgcaccgtgtgggccatctcggccctggtgtccttcctgcccatcctcatgcactggtggcgggcggagagcgacgaggcgcgccgctgctacaacgaccccaagtgctgcgacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagccgtgccgccccggcttcgcctcggaatccaaggtgtagggcccggcgcggggcgcggactccgggcacggcttcccaggggaacgaggagatctgtgtttacttaagaccgatagcaggtgaactcgaagcccacaatcctcgtctgaatcatccgaggcaaagagaaaagccacggaccgttgcacaaaaaggaaagtttgggaagggatgggagagtggcttgctgatgttccttgttgttttttttttcttttcttttctttcttcttcttttttttttttttttttttttctgtttgtggtccggccttcttttgtgtgtgcgtgtgatgcatctttagatttttttcccccaccaggtggtttttgacactctctgagaggaccggagtggaagatgggtgggttaggggaagggagaagcattaggaggggattaaaatcgatcatcgtggctcccatccctttcccgggaacaggaacacactaccagccagagagaggagaatgacagtttgtcaagacatatttccttttgctttccagagaaatttcattttaatttctaagtaatgatttctgctgttatgaaagcaaagagaaaggatggaggcaaaataaaaaaaaatcacgtttcaagaaatgttaagctcttcttggaacaagccccaccttgctttccttgtgtagggcaaacccgctgtcccccgcgcgcctgggtggtcaggctgagggatttctacctcacactgtgcatttgcacagcagatagaaagacttgtttatattaaacagcttatttatgtatcaatattagttggaaggaccaggcgcagagcctctctctgtgacatgtgactctgtcaattgaagacaggacattaaaagagagcgagagagagaaacagttcagattactgcacatgtggataaaaacaaaaacaaaaaaaaggagtggttcaaaatgccatttttgcacagtgttaggaattacaaaatccacagaagatgttacttgcacaaaaagaaattaaatattttttaaagggagaggggctgggcagatcttaaataaaattcaaactctacttctgttgtctagtatgttattgagctaatgattcattgggaaaatacctttttatactcctttatcatggtactgtaactgtatccatattataaatataattatcttaaggattttttatttttttttatgtccaagtgcccacgtgaatttgctggtgaaagttagcacttgtgtgtaaattctacttcctcttgtgtgttttaccaagtatttatactctggtgcaactaactactgtgtgaggaattggtccatgtgcaataaataccaatgaagcacaatcaa

SEQ ID NO: 1400 - DNA, 2041 bp, Homo sapiens
gcacataacgggcagaacgcactgcgaagcggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggcacccaatggaagccatgcgccggaccacgacgtcacgcaggaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccccaacagaacactaaacagactatttaacttgagggtaataaacttagaataaaattgtaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtctgctatattttcatgacttttccatgtatctacctcactattcaagtattaggggtaatatattgctgctggtaatttgtatctgaaggagattttccttcctacacccttggacttgaggattttgagtatctcggacctttcagctgtgaacatggactcttcccccactcctcttatttgctcacacggggtattttaggcagggatttgaggagcagcttcagttgttttcccgagcaaagtctaaagtttacagtaaataaattgtttgaccatgccttcattgc

SEQ ID NO: 1401 - DNA, 2943 bp, Homo sapiens
ctctgatacataaagggtggggatgggagcgctctcctctctccttcccctgccttgctgtgggaacttctgggaaaggaggtgcagggctccaggaagccagtgcccagggagtgctatgctgagtccaggagcctggccacggcaggggtggacagatggtggcagaggaaccacggtgtcccttcctccagatttagctaaaggaaacgtggagcatcccattggccatcctccccactctccaattcggctccagaggcccctccagactataggcagctgcccctttaagcgtcgctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacggggcttcttggggagtttcttaggcctgaaggacaagaagcaacaactctgttgatcagaacctgtggaaaacctctggcctctgttcagaatgagtcccatgggattccccggctgtgacactctaccctccagaacctgacgactgggccatgtgacccaaggagggatccttaccaagtgggttttcaccatcctcttgctctctgtctgagagatgttttctaaaccccagccttgaacttcactcctccctcagtggtagtgtccaggtgccgtggagcagcaggctggctttggtaggggcacccatcacccggcttgcctgtgcagtcagtgagtgcttagggcaaagagagctcccctggttccattccttctgccacccaaaccctgatgagaccttagtgttctccaggctctgtggcccaggctgagagcagcagggtagaaaagaccaagatttggggttttatctctggttcccttattactgctctcaagcagtggcctctctcactttagccatggaatggctccgatctacctcacagcagtgtcagaaggacttcgccagggttttgggagctccagggttcataagaaggtgaaccattagaacagatcccttcttttccttttgcaatcagataaataaatatcactgaatgcagttcatcctcggccccctttccctccgtttgttttcttttcataatccacttactcccttcccttctactctgcgctggcttttgacagaggcagtaaattaggcctaatcctcactcttttcttcctaatcttcatcaaacaaaaaatgaaaagtctgtctggacgaaggggagtgagcttgagcctttgatatcttgctcccccacccttcctgaaactcttgaaatccagttgccattgagtagcaaagccacgctccccacaggacttggacagagggcccacagggggatgggctggctgtggccaggtttagggcagggggcatttgtcccctccatgctataatccagtggtgccttacatggtgtgtgtgtgtgtgtgtgcgtgtgtgtgtgtgtgtgtgtgtctggaggcacaggcacaaagcattgcttgggttggtcaaatgtcttgtgtcataaatatattctgatgtttcccagcctttccacaacctctaccttcccactcaccttccccagctacaaaaatctgtattatcctcttaaagtaaaactggagttac

SEQ ID NO: 1402 - DNA, 1369 bp, Homo sapiens
gccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1403 - DNA, 715 bp, Homo sapiens
ctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacacc

SEQ ID NO: 1404 - DNA, 665 bp, Homo sapiens
atggctgccggaacagcagttggagcctgggtgctggtcctcagtctgtggggggcagtagtaggtgctcaaaacatcacagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 1405 - DNA, 864 bp, Homo sapiens
aggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatccca

SEQ ID NO: 1406 - DNA, 1250 bp, Homo sapiens
ctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1407 - DNA, 1371 bp, Homo sapiens
atggctgccggaacagcagttggagcctgggtgctggtcctcagtctgtggggtgagccactccctcaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 1408 - DNA, 1490 bp, Homo sapiens
gactgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatctt

SEQ ID NO: 1409 - DNA, 1492 bp, Homo sapiens
gactgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1410 - DNA, 1369 bp, Homo sapiens
gccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1411 - DNA, 1250 bp, Homo sapiens
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1412 - DNA, 1250 bp, Homo sapiens; identical to SEQ ID NO: 1411

SEQ ID NO: 1413 - DNA, 715 bp, Homo sapiens
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacacc

SEQ ID NO: 1414 - DNA, 716 bp, Homo sapiens
ggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgaagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgca

SEQ ID NO: 1415 - DNA, 716 bp, Homo sapiens; identical to SEQ ID NO: 1414

SEQ ID NO: 1416 - DNA, 715 bp, Homo sapiens
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacacc

SEQ ID NO: 1417 - DNA, 1492 bp, Homo sapiens
gactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1418 - DNA, 1369 bp, Homo sapiens; identical to SEQ ID NO: 1410

SEQ ID NO: 1419 - DNA, 715 bp, Homo sapiens; identical to SEQ ID NO: 1416

SEQ ID NO: 1420 - DNA, 1492 bp, Homo sapiens
gactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1421 - DNA, 716 bp, Homo sapiens
ggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgaagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgca

SEQ ID NO: 1422 - DNA, 1249 bp, Homo sapiens
aggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatccca

SEQ ID NO: 1423 - DNA, 1250 bp, Homo sapiens; identical to SEQ ID NO: 1411

SEQ ID NO: 1424 - DNA, 715 bp, Homo sapiens; identical to SEQ ID NO: 1416

SEQ ID NO: 1425 - DNA, 1250 bp, Homo sapiens; identical to SEQ ID NO: 1411

SEQ ID NO: 1426 - DNA, 716 bp, Homo sapiens; identical to SEQ ID NO: 1414

SEQ ID NO: 1427 - DNA, 1492 bp, Homo sapiens; identical to SEQ ID NO: 1420

SEQ ID NO: 1428 - DNA, 1250 bp, Homo sapiens
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1429 - DNA, 1369 bp, Homo sapiens; identical to SEQ ID NO: 1410

SEQ ID NO: 1430 - DNA, 716 bp, Homo sapiens
ggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgaagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgca

SEQ ID NO: 1431 - DNA, 1492 bp, Homo sapiens; identical to SEQ ID NO: 1420

SEQ ID NO: 1432 - DNA, 1369 bp, Homo sapiens
gccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 1433 - DNA, 715 bp, Homo sapiens; identical to SEQ ID NO: 1416

SEQ ID NO: 1434 - DNA, 1369 bp, Homo sapiens; identical to SEQ ID NO: 1410

SEQ ID NO: 1435 - DNA, 716 bp, Homo sapiens; identical to SEQ ID NO: 1414

SEQ ID NO: 1436 - DNA, 1492 bp, Homo sapiens; identical to SEQ ID NO: 1420

SEQ ID NO: 1437 - DNA, 387 bp, Homo sapiens
atggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagtttgagaaccttcacaattacagcctctga

SEQ ID NO: 1438 - DNA, 493 bp, Homo sapiens
aggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatccca

SEQ ID NO: 1439 - DNA, 1371 bp, Homo sapiens
atggcagccggaacagcagttggagcctgggtgctggtcctcagtctgtggggtgagccactccctcaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 1440 - DNA, 1371 bp, Homo sapiens
atggcagccggaacagcagttggagcctgggtgctggtcctcagtctgtggggtgagccactccctcaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 1441 - DNA, 864 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatccca

SEQ ID NO: 1442 - DNA, 1490 bp, Homo sapiens
gactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatctt

SEQ ID NO: 1443 - DNA, 1249 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatccca

SEQ ID NO: 1444 - DNA, 665 bp, Homo sapiens
atggcagccggaacagcagttggagcctgggtgctggtcctcagtctgtggggggcagtagtaggtgctcaaaacatcacagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 1445 - DNA, 387 bp, Homo sapiens
atggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagtttgagaaccttcacaattacagcctctga

SEQ ID NO: 1446 - DNA, 493 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatccca

SEQ ID NO: 1447 - DNA, 1490 bp, Homo sapiens; identical to SEQ ID NO: 1442

SEQ ID NO: 1448 - DNA, 864 bp, Homo sapiens; identical to SEQ ID NO: 1441

SEQ ID NO: 1449 - DNA, 387 bp, Homo sapiens
atggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagtttgagaaccttcacaattacagcctctga

SEQ ID NO: 1450 - DNA, 1371 bp, Homo sapiens; identical to SEQ ID NO: 1440

SEQ ID NO: 1451 - DNA, 864 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatccca

SEQ ID NO: 1452 - DNA, 493 bp, Homo sapiens; identical to SEQ ID NO: 1446

SEQ ID NO: 1453 - DNA, 1490 bp, Homo sapiens; identical to SEQ ID NO: 1442

SEQ ID NO: 1454 - DNA, 864 bp, Homo sapiens; identical to SEQ ID NO: 1441

SEQ ID NO: 1455 - DNA, 665 bp, Homo sapiens; identical to SEQ ID NO: 1444

SEQ ID NO: 1456 - DNA, 1371 bp, Homo sapiens; identical to SEQ ID NO: 1440

SEQ ID NO: 1457 - DNA, 665 bp, Homo sapiens; identical to SEQ ID NO: 1444

SEQ ID NO: 1458 - DNA, 1249 bp, Homo sapiens; identical to SEQ ID NO: 1443

SEQ ID NO: 1459 - DNA, 1490 bp, Homo sapiens
gactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatctt

SEQ ID NO: 1460 - DNA, 387 bp, Homo sapiens; identical to SEQ ID NO: 1449

SEQ ID NO: 1461 - DNA, 493 bp, Homo sapiens; identical to SEQ ID NO: 1446

SEQ ID NO: 1462 - DNA, 1249 bp, Homo sapiens; identical to SEQ ID NO: 1443

SEQ ID NO: 1463 - DNA, 864 bp, Homo sapiens; identical to SEQ ID NO: 1441

SEQ ID NO: 1464 - DNA, 665 bp, Homo sapiens; identical to SEQ ID NO: 1444

SEQ ID NO: 1465 - DNA, 387 bp, Homo sapiens; identical to SEQ ID NO: 1449

SEQ ID NO: 1466 - DNA, 1249 bp, Homo sapiens; identical to SEQ ID NO: 1443

SEQ ID NO: 1467 - DNA, 1490 bp, Homo sapiens; identical to SEQ ID NO: 1442

SEQ ID NO: 1468 - DNA, 493 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatccca

SEQ ID NO: 1469 - DNA, 665 bp, Homo sapiens; identical to SEQ ID NO: 1444

SEQ ID NO: 1470 - DNA, 1371 bp, Homo sapiens
atggcagccggaacagcagttggagcctgggtgctggtcctcagtctgtggggtgagccactcccccaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 1471 - DNA, 1249 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatccca

SEQ ID NO: 1472 - DNA, 493 bp, Homo sapiens; identical to SEQ ID NO: 1446

SEQ ID NO: 1473 - DNA, 387 bp, Homo sapiens; identical to SEQ ID NO: 1449

SEQ ID NO: 1474 - DNA, 2891 bp, Homo sapiens
agagtgtgatcttgtacaagttattcagcctttgcaaacctcagattcacacaatgtaagatgaagaaactcaccttctgaaaattagagataacatatgcaaagtgaatcaatacagggcttaacatatttatcacccctttggtaaataaccatgacgattaccagagctcttaagggcaatggcaggtgggaagcagaactcatgggtggtaatccccaggccagccaggctcaccatgtgcacttggacaagtccttgcccccatcattgtgaaatggtgcagggatgcaccatgagggtgtggcaggatggctgacaacagactgggaagcagctcggcagaaaaactggattgatgcccactatggcaagagatatcatctcccctcttgttctgtgatgtttcagtcctggaaagacaagcatcatgcctctgaccagtgccttcagggctgtggacaacgaccctgggatcattgtctggagaatagagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctaaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggggtctagtggggatgagcgggcaatggctaaggagctggccagccttctctgtgatggcagcgagaacactgtggccgagggccaggagccagccgagttctgggacctactgggagggaaaactccctatgccaatgataaaagacttcagcaggaaatcctagatgtccagtctcgtctctttgaatgttccaataagaccggccaattcgttgtcactgagatcacagacttcacccaggatgacctgaaccctactgacgtgatgctcctagatacctgggaccaggtgttcttgtggattggggctgaggccaatgccacggagaaggagagtgcccttgccacagcacagcagtacctgcacactcaccccagcggccgagatcccgacacaccaatcctgatcattaagcaggggtttgagcctcccatcttcacaggctggttcctagcctgggaccctaacatttggagtgcaggaaaaacatatgaacaattaaaagaagagctgggagatgctgctgctatcatgcgaatcactgctgacatgaagaatgcaaccctctccctgaattctaatgacagtgagccaaaatattaccctatagcagttctgttgaaaaaccagaatcaggagctgcctgaggatgtaaaccctgccaaaaaggagaattacctctctgaacaggactttgtgtctgtgtttggcatcacaagagggcaatttgcagctctgcctggctggaaacagctccaaatgaagaaagaaaaggggcttttctaa

SEQ ID NO: 1475 - DNA, 2939 bp, Homo sapiens
atgtcttccacggggcaccctggctcctacaaaatatggggagagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctaaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggggtctagtggggatgagcgggcaatggctaaggagctggccagccttctctgtgatggcagcgagaacactgtggccgagggccaggagccagccgagttctgggacctactgggagggaaaactccctatgccaatgataaaagacttcagcaggaaatcctagatgtccagtctcgtctctttgaatgttccaataagaccggccaattcgttgtcactgagatcacagacttcacccaggatgacctgaaccctactgacgtgatgctcctagatacctgggaccaggtgttcttgtggattggggctgaggccaatgccacggagaaggagagtgcccttgccacagcacagcagtacctgcacactcaccccagcggccgagatcccgacacaccaatcctgatcattaagcaggggtttgagcctcccatcttcacaggctggttcctagcctgggaccctaacatttggagtgcaggaaaaacatatgaacaattaaaagaagagctgggagatgctgctgctatcatgcgaatcactgctgacatgaagaatgcaaccctctccctgaattctaatgacagtgagccaaaatattaccctatagcagttctgttgaaaaaccagaatcaggagctgcctgaggatgtaaaccctgccaaaaaggagaattacctctctgaacaggactttgtgtctgtgtttggcatcacaagagggcaatttgcagctctgcctggctggaaacagctccaaatgaagaaagaaaaggggcttttctaaagcaagaaggcctatacctattgcaaggccacagaaaagagcagatagtgccaatatcaggaaataatttatccaccaatttctgcctgacattcagctacttaatttagatataatagagtctgcaaatcacggcatgttctccattttttctcatccttgcattccttgcttgttatatacctaaaatgttaaccatatagtttttgggttttgtggccctctagctaaagcctcagcagaaagcactaaaactgcataaatctggagaaatcaaaagaaagagaaccaaaaaacaatgcttaaaatgtttaataactttatgtttaatattataccaggacctacctttgttttcaattttaagatgattatttctaaaatctatttagcctgtaaatcattgaaatcatatatgcactccataggcaaaatccaaatacccagatctgtaatgtgtcaaagcatttttcacttttcaaataaagatacctataatg

SEQ ID NO: 1476 - DNA, 568 bp, Homo sapiens
gctttggagtggttcttcaatactgctgctgcttacgcgccgggaaactgggaaggctggtgagcgagaaggcaagtcctggaaagacaagcatcatgcctctgaccagtgccttcagggctgtggacaacgaccctgggatcattgtctggagaatagagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaa

SEQ ID NO: 1477 - DNA, 12280 bp, Homo sapiens
agttttggttgtggcaacccagaggaaggttgcagtggcccatctatctatcccagatgtaagatatgcttcacccctctttcttgatccatgaagttcaaaaggaggcaccaagcatttccgtccttcttcaagatgaaggtaagccttcccagtgatccaagctgtgttgaagaaatcttgcgggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 1478 - DNA, 7319 bp, Homo sapiens
gccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcc

SEQ ID NO: 1479 - DNA, 13641 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 1480 - DNA, 1488 bp, Homo sapiens
ccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaagtaagttattatttttattagttgcaaatgttaattttaacggactcgatgcatgtgaaaaaataaggtcataaaagagaccttggattttgagttaatctctattcatgacaatttaa

SEQ ID NO: 1481 - DNA, 13746 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaaggtagctgaatatacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggagatgacccattcctggcctactcctctcacttccatgcatactgctggacactctgagcagagcaccttttccatcccaggacaggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 1482 - DNA, 2032 bp, Homo sapiens
gttacttttttactgataatgtgaaagaatgatataaaaacttgattttcctcaacaacattactttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaag

SEQ ID NO: 1483 - DNA, 3185 bp, Homo sapiens
ggctggcggcaggagacgccgcgttgagagcttgggctcctccgtgagccgccggcgcgcttcgctgcctggcggcctttccccgagccgagcccgcttcccgaggccgccagtcgtcgcctgcccgcgcctgcgcagcgtcccgggccgagagggccacggcggcggccatggcgcaccgctgtttgcggctgtggggccggggcggctgctggccccgcggcctacagcagctcctcgtgcctggcggcgtgggcccgggcgagcagccctgcctccggacgctttaccgatttgttacaactcaagcaagggccagcagaaattctcttttgacagatataattgctgcttatcaaagattctgttctcgacccccaaaaggatttgaaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaagggtgccattctcactggtcctccaggcactgggaagacgctgctagctaaggccacagccggagaagccaatgtccccttcatcaccgttagtggatctgagtttttggagatgttcgttggtgtgggccctgctagagtccgagacttatttgcccttgctcggaagaatgccccttgcatcctcttcatcgatgaaatcgatgcggtgggaaggaagagaggaagaggcaactttggagggcagagtgagcaggagaacacactcaaccagctgctggtggagatggatggttttaatacaacaacaaatgtcgtcattttggccggcaccaatcgaccagatatcctggaccccgcgctgcttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgaacgagtgattggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagtctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctgtccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggctgtgaaattaaattggagtcttgataagaacattttaatttgacttaatattttaaagattgaatccagatcacttgttgctgtcttaatggaatggttttctacaggagctgtaacatacttaaaaatatgaatgtattatgtaaatatggcttctttacataaaaaataaaatgtcaacactgtacttttctgaacaca

SEQ ID NO: 1484 - DNA, 2860 bp, Homo sapiens
ggggctggcggcaggagacgccgcgttgagagcttgggctcctccgtgagccgccggcgcgcttcgctgcctggcggcctttccccgagccgagcccgcttcccgaggccgccagtcgtcgcctgcccgcgcctgcgcgagcagccctgcctccggacgctttaccgatttgttacaactcaagcaagggccagcagaaattctcttttgacagatataattgctgcttatcaaagattctgttctcgacccccaaaaggatttgaaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaagggtgccattctcactggtcctccaggcactgggaagacgctgctagctaaggccacagccggagaagccaatgtccccttcatcaccgttagtggatctgagtttttggagatgttcgttggtgtgggccctgctagagtccgagacttatttgcccttgctcggaagaatgccccttgcatcctcttcatcgatgaaatcgatgcggtgggaaggaagagaggaagaggcaactttggagggcagagtgagcaggagaacacactcaaccagctgctggtggagatggatggttttaatacaacaacaaatgtcgtcattttggccggcaccaatcgaccagatatcctggaccccgcgctgcttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgaacgagtgattggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagtctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctgtccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggct

SEQ ID NO: 1485 - DNA, 8498 bp, Homo sapiens
cacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattataatattataataataataaagacattggaagagat

SEQ ID NO: 1486 - DNA, 7526 bp, Homo sapiens
gccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaa

SEQ ID NO: 1487 - DNA, 8840 bp, Homo sapiens
cacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattataatattataataataataaagacattggaagagat

SEQ ID NO: 1488 - DNA, 7628 bp, Homo sapiens
gccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgc

SEQ ID NO: 1489 - DNA, 7593 bp, Homo sapiens
atgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactga

SEQ ID NO: 1490 - DNA, 764 bp, Homo sapiens
agctcctaggtccctgtcctgtggaaatttgtggaccctgggcaccctctcttgctcccaaattttaatcggctcctggaaacctcaccccaaattggagataggcactcctcttgtagaacaaaaggctcaggttcagggagtgagggcctgaactgtgcccccaccctccaggaagggtccttcacggcctggctgcagggatcagtcacgtgtggcccttcattaggccctgccatataagccaagggcacggggtggccgggaactctctaggcaagaatcccggaggcagaggccatgctgaccgcagcggtgctgagctgtgccctgctgctggcactgcctgccacgcgaggagcccagatgggcttggcccccatggagggcatcagaaggcctgaccaggccctgctcccagagctcccaggcctgggcctgcgggccccactgaagaagacaactgcagaacaggcagaagaggatctgttgcaggaggctcaggccttggcagaggtactagacctgcaggaccgcgagccccgctcctcacgtcgctgcgtaaggctgcatgagtcctgcctgggacagcaggtgccttgctgtgacccatgtgccacgtgctactgccgcttcttcaatgccttctgctactgccgcaagctgggtactgccatgaatccctgcagccgcacctagctggccaacgtcagggtcggggctagggtaggggcaaggaaactcgaataaaggatgggaccaac

SEQ ID NO: 1491 - DNA, 586 bp, Homo sapiens
gcctcctgggatggatgtcacccgcttactcctggccaccctgctggtcttcctctgcttcttcactgccaacagccacctgccacctgaggagaagctccgagatgacaggagcctgagaagcaactcctctgtgaacctactggatgtcccttctgtctctattgtggcgctgaacaagaaatccaaacagatcggcagaaaagcagcagaaaagaaaagatcttctaagaaggaggcttcgatgaagaaagtggtgcggccccggacccccctatctgcgccctgcgtggccacccgcaacagctgcaagccgccggcacccgcctgctgcgacccgtgcgcctcctgccagtgccgcttcttccgcagcgcctgctcctgccgcgtgctcagcctcaactgctgagcgcccccactcccggccgcgagcaggcagggcttcggggacgcggggcgcttctcgggcgggtgatccctaacagggcggcttcccagggctgcaggcgggcggaggttccaggagatgggacttcagggagacctggcttgggctaaaatcgaaatacaatatatataggctgct

SEQ ID NO: 1492 - DNA, 2668 bp, Homo sapiens
ctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccgaaatcccgcaaggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgaactggccaatgagatccccgtccccgaaactctggattccggggcccttcacagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaacttt

SEQ ID NO: 1493 - DNA, 7323 bp, Homo sapiens
cccgtccccggcgcggcccgcgcgctcctccgccgcctctcgcctgcgccatggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaa

SEQ ID NO: 1494 - DNA, 813 bp, Homo sapiens
ccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccgaaatcccgcaaggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgaactggccaatgagatccccgtccccgaaactctggattccggggcccttcacagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaa

SEQ ID NO: 1495 - DNA, 1440 bp, Homo sapiens
gactgaaaactggatatttggtccccatggactttctggtcaccctgtgaagtggacttaactttttcttgaatcatgtggaaggattctgaagtcaaaagtttttaagactctcaggcttactgtggatctggattctaaggcaacacttccttgaagaaacaagcttacagtctgtggcccagacccaggcaagtggtaaatatttaccttcacgctggagccaagatcgctgcggggagtcccgtgaagcaccactgccctctaagaccttggaaggggaaacaccagaaggtgtgggtgctgagctccgctgcgtcagactgccaggacctgagtggaactcagtgctgaaacctgggttctcactgcagctggatagcagctctgcccggatggccctagtcttcgtgtacggcaccctgaagcggggtcagcccaaccacagggtcctgcgggacggcgcccacggctccgcagcctttcgggcgcgcggccgcacgctggagccctacccgttggtgatcgcgggggagcacaacatcccgtggctgctgcacctgcccggctcggggcgcctcgtggagggcgaggtctacgcggtagacgagcggatgctgcgctttctggatgacttcgagagttgcccggccctgtaccagcgcacggtgctgcgggtacagctgctggaggaccgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatcagatataaaa

SEQ ID NO: 1496 - DNA, 1226 bp, Homo sapiens
atttaccttcacgctggagccaagatcgctgcggggagtcccgtgaagcaccactgccctctaagaccttggaaggggaaacaccagaaggtgtgggtgctgagctccgctgcgtcagactgccaggacctgagtggaactcagtgctgaaacctgggttctcactgcagctggatagcagctctgcccggatggccctagtcttcgtgtacggcaccctgaagcggggtcagcccaaccacagggtcctgcgggacggcgcccacggctccgcagcctttcgggcgcgcggccgcacgctggagccctacccgttggtgatcgcgggggagcacaacatcccgtggctgctgcacctgcccggctcggggcgcctcgtggagggcgaggtctacgcggtagacgagcggatgctgcgctttctggatgacttcgagagttgcccggccctgtaccagcgcacggtgctgcgggtacagctgctggaggaccgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatc

SEQ ID NO: 1497 - DNA, 2222 bp, Homo sapiens
ggggtggggcggggcggggatcaagcaggggcagggctggcgctgcggcgggagatgctgtcgggccgcggcggcgcttggcagccaggagctctgcattgaaggcactggggtgaggcttactgcccggcaggctggtgggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgacttgaaaactgctggaacaatagtgattaataaagatatgtatagataattcagctgttaaataacattttctaatttgtataaatggtactatggtactaataaaaacctaaattctccaaccaatttttttaaactgccaggaacaccca

SEQ ID NO: 1498 - DNA, 2426 bp, Homo sapiens
ggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgacttgaaaactgctggaacaatagtgattaataaagatatgtatagataattcagctgttaaataacattttctaatttgtataaatggtactatggtactaataaaaacctaaattctccaaccaatttttttaaactgccaggaacacccaaaaatatttttaaatatatcaccttaatagacatttcttttagataactccctcctaaaggaagaggtcataagttttcatattaatcccctcaattcaacttgattaaaatcttttcttagctggttgatccctatataacaaaaaactggagaatttaaaacattcccaaaaggtggctataggggttttaacattttaaaaaaatataaaagcattaaagaaaatattggatgttta

SEQ ID NO: 1499 - DNA, 1865 bp, Homo sapiens
gcctgccaagcctcaattatctgtgctccgaccctttaagaaacacttctctcacccctgagctaagcagaataagaggggctggacgtgcaggactcagagtgggagcgaggagggctggggtgaggacagctttgtcacactctgtttttctgtcactcagccctgggggctccctctgcctgagggcttcgtcccctgctgcctggccgtgacccgcagcacaagcacagataagcctcagggaacaaaaggcagggctgccacggaagcccatccaccaatcctcacctctcacctctgtgtccgccctgctgggaaatattccaggctttggccaaggccagtgcagccccaggttcccgagcggcaggttgggtgcggaccatggcctctcacaagctgctggtgaccccccccaaggccctgctcaagcccctctccatccccaaccagctcctgctggggcctggtccttccaacctgcctcctcgcatcatggcagccggggggctgcagatgatcgggtccatgagcaaggatatgtaccagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggcagcgagccgtggacatcggggagcgcataggagcccgagtgcacccgatgaccaaggaccctggaggccactacacactgcaggaggtggaggagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaggcatcgacatcctgtactcgggctcccagaaggccctgaacgcccctccagggacctcgctcatctccttcagtgacaaggccaaaaagaagatgtactcccgcaagacgaagcccttctccttctacctggacatcaagtggctggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccaactctcctcac

SEQ ID NO: 1500 - DNA, 2364 bp, Homo sapiens
ctctttttctcccccttgaaggcactgttactagaaatagagagctctggggcttgcctgaagccatgggcagtcaccactccaggattccccttttagcgcctcctccccatcttaatctcaaagtccagcaggatagtgagcagttagagcccggcctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaagcagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccaacaatgtgtccagatgtttttcgtggcccttggggaggaagccactgtcgagattctccagtgcaaacaatcaggaagtgcagctgtgcaccagactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctttgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggtgattaaagaagaaaatctacaggaaaacagtcaagaagttgggacctacatgttactaaagtttgctaagctgcgggatgaatttgaaattgttggagacgtccgaggcaaaggtctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaagaatttgccacgtatgttcaagggtgaatttgaagaatttcagaaccactggtatccagagaaagcctgcagctctccacaggagctgtaaaagtcatggttgactgcctaccaaccatatttgttagcagagcccctcttatcttgagaactccattcttcagggaaaggatctccctagctcagagaataaatcctaattagtttatgttaggtatggtaatttgattcccctttgcagtgattggtttatgcatgaatatgtgatgtatttttgtccagtgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtagtcatgaggacaaccctttttggtgaggttggaagatggatggaagccaagtgcttagtgatgtcaaagaagcactcacttaagcattcctggagccaccctacctcagggcctcttgatatttgaggtaataaattcattgttctgtat

SEQ ID NO: 1501 - DNA, 3344 bp, Homo sapiens
ggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccacgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagttccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgc

SEQ ID NO: 1502 - DNA, 3854 bp, Homo sapiens
acgatggcagcgtcagtggcagctgcagcccggaggctgcggcgggccattcgaaggtcgcccgcatggcggggcctcagccatcggccgctctcatcggagccccctgcagccaaggcctcggccgtgagggccgcctttctgaacttctttcgggaccgccatggccaccggctggtgccctccgcttccgtgcggccccgcggcgaccccagtttgctttttgtcaatgcgggcatgaaccagttcaagccaatctttctgggcaccgtggatccacgaagcgagatggcaggcttccgacgtgtggccaacagccagaaatgtgtgagagctggaggacaccataacgacctggaagatgtgggtcgagacctttcccatcataccttctttgaaatgcttggcaattgggcctttgggggtgaatattttaaggaggaggcttgtaacatggcctgggaactgctgactcaggtctatgggatccctgaggaaaggctctggatctcctactttgatggtgaccccaaggcagggctggacccagacctggagaccagggacatctggctgagcttaggggtgcctgctagccgtgtgctttcctttggaccacaagagaacttctgggagatgggggatactggcccttgtgggccctgtactgagatccactacgaccttgctggtggggtgggagccccccagctggtagagctttggaacctggtcttcatgcaacacaacagagaggcagatggaagcctgcagcccctgccccagcggcatgtggacacaggaatgggcctggaaaggctggtggctgtgctgcaaggcaaacactccacctatgacactgacctcttttccccgctgctcaacgccatacagcagggctgcagggcacccccttacttgggccgagtaggggtggcagacgaggggcgcacagacacagcgtaccgcgtggtggctgaccacatccgcacactcagtgtctgcatctctgatggcatcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaggcagtagcccctgagtgcctgcggttaggggaccaggtgcagctgcatgtggatgaggcctggcgtctaggctgcatggcgaagcatacggccacccacctgctgaactgggcactgaggcagaccctgggccctggcacagagcagcagggctcccatctcaatcctgagcagctgcgcttggatgtgaccacccagaccccattgaccccagagcagctccgggcagtggagaacactgtgcaggaggccgtggggcaggatgaggctgtgtacatggaggaggtgcccctggcgctcactgcccaggtccctggcctgcgctctctggatgaggtttacccagaccctgtgcgggtggtatcagtgggggtgcccgtggcccatgcattggacccagcctcccaagccgcactgcagacctctgtggagctatgctgtgggacgcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaagaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcacgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacgtgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcaggagatcaaaaccatcctggctaacatggtgaaaccccatctctactaaaaatacaaaaaattagccgggtgtggtggcacacgcctgtagtcccagctactcgggaggctgaggcagaagaatcgcttgaacctgggaggtggaggttgcagtgggccaagatcgcaccactgcactccagcctgggtgacagagcgagactctgtctcaaataattatttcacagaggatagcaagctccagaaggttctattacctttaaaaaagagtagttttgcccctcccagcaacctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaac

SEQ ID NO: 1503 - DNA, 1790 bp, Homo sapiens
tggagattccctgctccaagtcttctgggcgctccaggttctgtgaggccccacgggagccccggacccctggtctctgtaactgtggggtgagggaaggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 1504 - DNA, 2042 bp, Homo sapiens
ggcggggcctgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactc

SEQ ID NO: 1505 - DNA, 2170 bp, Homo sapiens
gcaacggcgcggtggcctggaaccccaggggagtggtgggcggggcctgaagtacccaagtccccgagggcgcgccttccccgggaatttaattcaggacaataatgttttattgagcgcctattgtgaatcagacactgagcagtaagcgtcggagaaacaggtgaatgataccggggaaaagtcattccctgtgtgtagcgtctagggcagcctttgccctggttccagcagatgggttgtctcttcatagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactc

SEQ ID NO: 1506 - DNA, 1302 bp, Homo sapiens
atggcgttctggtgtcagcgtgacagttatgcccgagagttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactc

SEQ ID NO: 1507 - DNA, 1905 bp, Homo sapiens
gcaacggcgcggtggcctggaaccccaggggagtggtgggcggggcctgaagtacccaagtccccgagggcgcgccttccccgggaatttaattcaggacaataatgttttattgagcgcctattgtgaatcagacactgagcagtaagcgtcggagaaacaggtgaatgataccggggaaaagtcattccctgtgtgtagcgtctagggcagcctttgccctggttccagcagatgggttgtctcttcatagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgttctctgtctgtttccttcttgtacttattcctcctggtggcaagcctcttctccctctagtaaccaagctggggtgcttcctcttgcccagatttgtgctctgatttcttacagctaattctgtcatctctagaaccagccacttcagcttcctgcacactctagaaatctctttatactttttttttttttttccgagatggagtcttgctctgtcgcccaggctggagtgcagtggtgcagtctctgttcactgcaacctccaccttctgggttcaagcaattctcctgcctcagcctcccaagtagatgggactacagatgtgcaccaccaggcccagctaatttttgtatttttagcagagatggggtttcaccatgttggccaggctggtctcgaactcctgacctcaagtaatccacccacctcagcctcccaaagtgctaggattacatgtatgagccaccacacccggccctctttatacttttaaaactgattgttactctagttaatgtctatgtttatttgtccaacagctattctatttgtccataaacttttttgagtgcctaatatgtacagttgactgtaacttaaacaaaataaatgcattgcctatagactttgctcttg

SEQ ID NO: 1508 - DNA, 594 bp, Homo sapiens
aactctaaatgccaccctggagcgggagccgcaatggcacgctccactttgaaaaaactgtggcatcaaaggtccctgggtagtcccttcccaaatgacctcagtcttccctctcccacccctatgaagccacacctcaacttctcttcaggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtct

SEQ ID NO: 1509 - DNA, 2263 bp, Homo sapiens
aattattggttaaagaagtatattagtgctaatttccctccgtttgtcctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaa

SEQ ID NO: 1510 - DNA, 1418 bp, Homo sapiens
ctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 1511 - DNA, 1483 bp, Homo sapiens
ctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaa

SEQ ID NO: 1512 - DNA, 1911 bp, Homo sapiens
cctttggcacaatgaagtgggtaacctttatttcccttctttttctctttagctcggcttattccaggggtgtgtttcgtcgagatgcactattcttgtttttcttcccttgcccagacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagaga

SEQ ID NO: 1513 - DNA, 1499 bp, Homo sapiens
aagcaaaaaaaataaataaatacctatgcaatacacctgctttatgcacttgagcagggaagaaatccacaaggactcaccagtctcctggtctgcagagaagacagaatcaacatgagcacagcaggaaaagtaatcaaatgcaaagcagctgtgctatgggagttaaagaaacccttttccattgaggaggtggaggttgcacctcctaaggcccatgaagttcgtattaagatggtggctgtaggaatctgtggcacagatgaccacgtggttagtggtaccatggtgaccccacttcctgtgattttaggccatgaggcagccggcatcgtggagagtgttggagaaggggtgactacagtcaaaccaggtgataaagtcatcccactcgctattcctcagtgtggaaaatgcagaatttgtaaaaacccggagagcaactactgcttgaaaaacgatgtaagcaatcctcaggggaccctgcaggatggcaccagcaggttcacctgcaggaggaagcccatccaccacttccttggcatcagcaccttctcacagtacacagtggtggatgaaaatgcagtagccaaaattgatgcagcctcgcctctagagaaagtctgtctcattggctgtggattttcaactggttatgggtctgcagtcaatgttgccaaggtcaccccaggctctacctgtgctgtgtttggcctgggaggggtcggcctatctgctattatgggctgtaaagcagctggggcagccagaatcattgcggtggacatcaacaaggacaaatttgcaaaggccaaagagttgggtgccactgaatgcatcaaccctcaagactacaagaaacccatccaggaggtgctaaaggaaatgactgatggaggtgtggatttttcatttgaagtcatcggtcggcttgacaccatgatggcttccctgttatgttgtcatgaggcatgtggcacaagtgtcatcgtaggggtacctcctgattcccaaaacctctcaatgaaccctatgctgctactgactggacgtacctggaagggagctattcttggtggctttaaaagtaaagaatgtgtcccaaaacttgtggctgattttatggctaagaagttttcattggatgcattaataacccatgttttaccttttgaaaaaataaatgaaggatttgacctgcttcactctgggaaaagtatccgtaccattctgatgttttgagacaatacagatgttttcccttgtggcagtcttcagcctcctctaccctacatgatctggagcaacagctgggaaatatcattaattctgctcatcacagattttatcaataaattacatttgggggctttccaaagaaatggaaattgatgtaaaattatttttcaagcaaatgtttaaaatccaaatgagaactaaataaagtgttgaacatcagctggggaattgaagccaataaaccttccttcttaaccatt

SEQ ID NO: 1514 - DNA, 4072 bp, Homo sapiens
gcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccaagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaagggccatgtaaatgtgggtaacctgattgttttgtcaaaaatgctaaagcggggtggggggtggcgcagtggcttatccctgtaatcccagcactttgggaggtcaagacgggtggatgacctgaggtcaggagtttgagaccagcctggtcaacatggtgaaaccccatctctactaaaaatacaaaaatttgccaggcatggtggcaggtggctgtaatcccagctactcaggaggctgaggcaagagaatcgctggagcctgggaggcggaggttgcagtgagcagaaatcttgccactgcacagcagcctaggcgacaagagcaaaactctgtcaaaagaaaagaaaagaaaatgctgaaggagttactcagggtcaagaaagttttcagaatgtccgtaagataacatcatcatgggacactacctgttgctgggtgctctgcggcttttacactgatgctgattgtgtgagatccagaaaaagaaaatggagttctacatgcccatctcacagcagggtcatcaaatcctgctagtgacacagaagctgacatccagctcccacccgccttcctcccaggttcggggagcaggtagagtgggagccattaggtgggctctgccagtgttgtcatagagtggcaagtcctccatgggatgggagtggcatgtgggagccttctgcatcatgcactatgaaaaaagaaaatttactatggggcaagtggttcatatagttaagtgattgtatatatatatatatatatatatatatatatatatatatatatatatacactatggggcaagtggttcatatagttaagtgattgtatatatatatatatatatatatgtattccagtgtagaaagtattggctgggtctgtaatcaagtattccacagaagtgccttcataggtgctgaaacaggattatgagagtgacagacacaggactgaagacagggagaaaatgtgcatggctgtgagaatatattgctttgattctttgacttctcatgatatatgaaaacaaataaagtgggggggggtgacttcaataatatcacgaacatatttaaaatgaaattctgagcatggagaaaaatttcaaattctggtataaacaaataatctaaaaatatagataaggaaaaaatgttttcatttttttggtcatattgatttgggtcatatatgattgaccaaaaaaaaagatatttctaaaatcctggtgctttttcatttaaaaatagacaaccaaagaggaaaatgaacaatgatggaaattcgtggaagaggaaactaaaatggcaaaatagcatattaaatggcactgagccttggtgtgatcaaaaaaaaaaataaagcaaaatgagatattactgctta

SEQ ID NO: 1515 - DNA, 4059 bp, Homo sapiens
gcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccaagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaagggccatgtaaatgtgggtaacctgattgttttgtcaaaaatgctaaagcggggtggggggtggcgcagtggcttatccctgtaatcccagcactttgggaggtcaagacgggtggatgacctgaggtcaggagtttgagaccagcctggtcaacatggtgaaaccccatctctactaaaaatacaaaaatttgccaggcatggtggcaggtggctgtaatcccagctactcaggaggctgaggcaagagaatcgctggagcctgggaggcggaggttgcagtgagcagaaatcttgccactgcacagcagcctaggcgacaagagcaaaactctgtcaaaagaaaagaaaagaaaatgctgaaggagttactcagggtcaagaaagttttcagaatgtccgtaagataacatcatcatgggacactacctgttgctgggtgctctgcggcttttacactgatgctgattgtgtgagatccagaaaaagaaaatggagttctacatgcccatctcacagcagggtcatcaaatcctgctagtgacacagaagctgacatccagctcccacccgccttcctcccaggttcggggagcaggtagagtgggagccattaggtgggctctgccagtgttgtcatagagtggcaagtcctccatgggatgggagtggcatgtgggagccttctgcatcatgcactatgaaaaaagaaaatttactatggggcaagtggttcatatagttaagtgattgtatatatatatatatatatatatatatatatatatatatatatatatacactatggggcaagtggttcatatagttaagtgattgtatatatatatatatatatatatgtattccagtgtagaaagtattggctgggtctgtaatcaagtattccacagaagtgccttcataggtgctgaaacaggattatgagagtgacagacacaggactgaagacagggagaaaatgtgcatggctgtgagaatatattgctttgattctttgacttctcatgatatatgaaaacaaataaagtgggggggggtgacttcaataatatcacgaacatatttaaaatgaaattctgagcatggagaaaaatttcaaattctggtataaacaaataatctaaaaatatagataaggaaaaaatgttttcatttttttggtcatattgatttgggtcatatatgattgaccaaaaaaaaagatatttctaaaatcctggtgctttttcatttaaaaatagacaaccaaagaggaaaatgaacaatgatggaaattcgtggaagaggaaactaaaatggcaaaatagcatattaaatggcactgagccttggtgtgatcaaaaaaaaaaataaagcaaaatgag

SEQ ID NO: 1516 - DNA, 1231 bp, Homo sapiens
gcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctagga

SEQ ID NO: 1517 - DNA, 1993 bp, Homo sapiens
acggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactatttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcgtccgaacaatcctcatcttttgaagatgccaggagcaattcagaatactatctgattgaatgtgaacctgcctggttaatttattacctgatttgatgaaccaaggaaagccatgagtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggagatg

SEQ ID NO: 1518 - DNA, 1961 bp, Homo sapiens
atgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactatttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcgtccgaacaatcctcatcttttgaagatgccaggagcaattcagaatactatctgattgaatgtgaacctgcctggttaatttattacctgatttgatgaaccaaggaaagccatgagtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaa

SEQ ID NO: 1519 - DNA, 2612 bp, Homo sapiens
gcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatcttgaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacat

SEQ ID NO: 1520 - DNA, 1691 bp, Homo sapiens
tgtattttgaaaacaacagaaaagaaatacttttgtacactctgttagaaattttaagtttggacatttaaaagtccaaatttaaaactcaaaaaaatggataataagaggggacctgtttgattaagggagaaaaaaatagtttgcattttcaccttttgtgctctttcactgagatgagcctatttcagattacacttaggaacttccatcaagcagcgggagagcctacttttcctgtttaataattaccagactacagagaaagctcaggacccagccttctgatctaccagtcgcctgtgtacctttgtactttctacagtgaaagttgctacaggatctccctttctcaataaattcatctgcggtggagaaaatcagcatgtgtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatggtaaactgcccacataaattttatgtctgtgtgtttgagaccaagagaaagggtgtattggcttgggagtagaagaagggtcgtccctgctgcagaagctgtatactgataattgaagaggctttcaggaatttgtaaagcatctccttcccctctgcattttgttttatttctagctaataaaatacataatcctgaaagta

SEQ ID NO: 1521 - DNA, 2802 bp, Homo sapiens
accagtcgcctgtgtacctttgtactttctacagtgaaagttgctacaggatctccctttctcaataaattcatctgcggtggagaaaatcagcatgtgtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttagcaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagcca

SEQ ID NO: 1522 - DNA, 991 bp, Homo sapiens
atctgcggtggagaaaatcagcatgtgtactacaggccaagtcatcagatgcaaagcagccatactctggaagcctggtgcaccattttctattgaagaggtagaagtggccccaccaaaggcaaaggaagttcgcataaaggtgacaaagttatcacactctttctgccacagtgtggagaatgtacctcttgcctgaattctgagggcaatttttgtatacaattcaagtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaa

SEQ ID NO: 1523 - DNA, 2289 bp, Homo sapiens
tttcaatagctttgattatcttgtttttgttagatccctcctcttggtttgatcatagtagttactgtatttctttttataagttggtctgcaaagggtagggcttgcagaccattgcaaagttgtgacggctgtgagtcatattgctgaaggtggaactctgaagccagactatctatgtgaaggcacaagctgctgttatatacaacagagtgaactgagcatcagtcagaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatataactcaaaacagatatagcgtataaagatatagtaaatgcatctcctagagtaatattcacttaacacattgaaactattattttttagatttgaatataaatgtattttttaaacacttgttatgagttaagttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagaatcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattatataaaatg

SEQ ID NO: 1524 - DNA, 2516 bp, Homo sapiens
ctgttttcatttatatttaattccagaaaccacatcaagtctttgcagaatgaagtagagcattaagaagtagagatgtacacacgcatctctaaaatcagccatgcctaggcaaagcagcttgcacttaaacacccaatacatttttcatgattgtgttgaagtgaagtaacctaacccgtttttatatccttcaaaataaggtggataggaatgctttcagcccttttcaatagctttgattatcttgtttttgttagatccctcctcttggtttgatcatagtagttactgtatttctttttataagttggtctgcaaagggtagggcttgcagaccattgcaaagttgtgacggctgtgagtcatattgctgaaggtggaactctgaagccagactatctatgtgaaggcacaagctgctgttatatacaacagagtgaactgagcatcagtcagaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatataactcaaaacagatatagcgtataaagatatagtaaatgcatctcctagagtaatattcacttaacacattgaaactattattttttagatttgaatataaatgtattttttaaacacttgttatgagttaagttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagaatcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattatataaaatg

SEQ ID NO: 1525 - DNA, 1325 bp, Homo sapiens
aattaaacacttggagatattccttgaggaatgaaatgcttggtgagcaggcatacagtgagggaaacactggatatggtgtttcagagaatgtcagtggaagcaggggttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtaga

SEQ ID NO: 1526 - DNA, 1420 bp, Homo sapiens
gtctatgtttgcagaaatacagatccaagacaaagacaggatgggcactgctggaaaattttttccataggtcctttgcctgctatgtatctcccaggatgtaagtgtggtatgtggaagtgggaaggagtgttaggagtgaagttgttaacacttcctctgtaaatttgagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaag

SEQ ID NO: 1527 - DNA, 946 bp, Homo sapiens
agcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatga

SEQ ID NO: 1528 - DNA, 1990 bp, Homo sapiens
gacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccctgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgcgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaaccttaagtattcattattggtatatagatcacttatagtatactagacagtggaatactatggtactgttaataaagatgaagtaaatctcttggaaa

SEQ ID NO: 1529 - DNA, 2758 bp, Homo sapiens
acaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagag

SEQ ID NO: 1530 - DNA, 2107 bp, Homo sapiens
ctatcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgtta

SEQ ID NO: 1531 - DNA, 822 bp, Homo sapiens
tctatcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatggggccagtgttgtatagccgcatccaggatttttgtggaagaatcaatttatgatgagtttgttcgaaggagtgttgagcgggctaagaa

SEQ ID NO: 1532 - DNA, 806 bp, Homo sapiens
agaagtccaggatgggaagagagatctgcagactcccagggaacctacagctttctccttcacagcattgcaggaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatat

SEQ ID NO: 1533 - DNA, 1001 bp, Homo sapiens
atcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggttttgtggaagaatcaatttatga

SEQ ID NO: 1534 - DNA, 805 bp, Homo sapiens
gtggccaggatcgggtctgggaagctcggagatttcactgtgagtggagtcagagggaaggcatttggagcaaaggcttctgtaagagggagtaggatggaaattgatctttgaagaaagcaagacagaagaagggagatggaaagatgaaatcattttaaaattgctggtaacaaacgaaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctc

SEQ ID NO: 1535 - DNA, 4098 bp, Homo sapiens
attctgagcccgaggcgagggggactcgcacccactgccacctctccctgaccctctggccaccatgcacctcggcccggctgaggggagtcggggggtcgggggagagggcgtagctgccgagagcctggcgcccctgcccggaggaggagaacggaggacgccctcccgggtctccggaaaggaagggggacggggttcggtgggtcctgggacggggatgggagggaacgtgggcgagctgggagccgccctccgcagcctggactttcctggcctttctctactccgaagcagcaccgggccgctccggtccccgccagcccctgccagctccgcttccgggggccacgaccctcgctcgacttcggccgctgtgcgcctcccgccgactctgacccagggacccggagaccaagtccggctggccgaggcccgcgggccgcggcgcaagttccgctcccaccgtcgaggactgtggaggcggcgtgggctggtctccgcggccggggggcgggagcgccgggcggacttgaccgtgggcgccaagcgtcccggccgcgcggcgcgggctttatgtaaatggaggctgcgccgggcgtcctaggtaggatggaccagccccccgcgcctcggccctcacgtccaataagaagagccccagcttgacacctgcctatatacaggcgagcgcgcccccgggccgcggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgtactcct

SEQ ID NO: 1536 - DNA, 3297 bp, Homo sapiens
atacaggcgagcgcgcccccgggccgcggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtg

SEQ ID NO: 1537 - DNA, 3049 bp, Homo sapiens
gacacccggcccgccaccatgacttccagcaagatagagatgcccggcgaggtgaaggccgaccccgccgccctcatggcgtcgctgcacctcctgccgtcgcccacgcccaatctcgaaattaagtacaccaaggtgtgaaaattggacttgctggcagaatcctttttgggagaagatgaagaatcagtgtgagactgtttggttaaaatccccaataaaactgaaactgatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcat

SEQ ID NO: 1538 - DNA, 3237 bp, Homo sapiens
atgaaaggtaagaactgtaatgatgttaaaatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgt

SEQ ID NO: 1539 - DNA, 577 bp, Homo sapiens
cagcctctagtaacttgtttcttcctggaaaagatgaatctgatcccaattaacttaaataaaacaaaccaaacaaaactctccactaccagcctggcagctagggaggcattattgggtctgaatgtaggaaatcaggaaatacttacaatcaagatgaacgtgcccaagaactcagagagggtttctttcgctaagctgctcttcaagaccagtctctgcttgaagctttttcccttttctgctccctcaggctgcatcttggggcttctctgaggactcctgtttctaccaatacctacctgttgtggtcctcactttcacagccagatgaaaatggacgttttgacaatggctcacagattcctggagatgtctgatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctg

SEQ ID NO: 1540 - DNA, 1664 bp, Homo sapiens
agagcagcaggatggcacttggtgtctggatgcctttggagttgcacatacagcttctttatgaaaggaagaaactggaagacaacaaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggcca

SEQ ID NO: 1541 - DNA, 664 bp, Homo sapiens
agctatagtctggcaggaaaactggactgagtggactagcttggggatcgtcaagactcttgatcttattggaggcagcttggtacattgcaatgagggggagatttgggatcagggaacctgggatggagccatgtctttctcccttcccagctgtgtaaccttggacaagtcacttaacctccaagactcactttcctccttcatcaagtgctgtgtgaagaatgcaggagagtgatttaagcaaagccccctaactgcctggcgtctagtaagtacacaggcagtgtgtacacaaggaaggaaatggcaggctgttcatatgcagcaagatccacacttggccaaacctggggtcacagagatggacatggaatcgagggcagaagatctgggtttgagtccagcagtgctttagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgca

SEQ ID NO: 1542 - DNA, 1468 bp, Homo sapiens
agtacaccactacatgctcatgcttcacttttttcatgacagtggatggttcttcctttatttggagtgtttttcttcagttgtgcctcttcctctctaacaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcc

SEQ ID NO: 1543 - DNA, 554 bp, Homo sapiens
attgaagcattattataagctccagagtacacgtcttctgtggattttcagtcgtacttacaatttcatgctcagaagaggcctttagtatatattttgcagtgtcttctgtgaagtcaaatttctgctcagatctttataaacaacgagtggcagaactcagagagtgggagagtgttccctgtctataatccagccacaggagaacaggtgtgtgaagttcaagaagcagacaagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtgga

SEQ ID NO: 1544 - DNA, 3924 bp, Homo sapiens
attcccgagcgccgcgagccggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaa

SEQ ID NO: 1545 - DNA, 891 bp, Homo sapiens
agcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatgg

SEQ ID NO: 1546 - DNA, 3066 bp, Homo sapiens
aggcggagcctcattggccgctgagccccgggctgcgcggaggcgggacctgcggccagccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcattgggcacgtggctgaaggtgaccgggctgatgtggatcgggccgtgaaagcagcccgggaagccttccgcctggggtccccatggcgccggatggatgcctctgagcggggccggctgctgaaccgcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacgtggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaagagcagctgtcagggaggcccagtcacagtccagcaattccacaaccaccttgacgaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccgtcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccaggggatagaggagtaattgttagtgggcatgggatttgtttttgggaggttttgaaaatgttctggagttgaacaatagtaatggttgcatgatttggtaaaaatactaaaaactatggaattgtttaattatggtatatgaattaatttctttctttttttcttttttttttttttttttgacacggagtctcactctgtcgcccaggctggagtgcagtggtgtgatctcgtctcactgcaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagcaaa

SEQ ID NO: 1547 - DNA, 1595 bp, Homo sapiens
agccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaagagcagctgtcagggaggcccagtcacagtccagcaattccacaaccaccttgacgaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccgtcaactgatgagtggattaataaaatgtttccatg

SEQ ID NO: 1548 - DNA, 3179 bp, Homo sapiens
tctgcggcaccaggactgagtagaagggagagagtggagaaggggaattgcagagagaaaaccaggggctgtttttctctcggagaggcgggtaggcactgggcgggcagaagcgccgctatccacccggatgcgcagctgctaaggggccgcctctgcaagcggctgcaaattcccggagggcagcgtctcctttcgctctgctgtgtccgtagcacatggcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagac

SEQ ID NO: 1549 - DNA, 2797 bp, Homo sapiens
ctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaaggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaag

SEQ ID NO: 1550 - DNA, 3277 bp, Homo sapiens
acagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagag

SEQ ID NO: 1551 - DNA, 1010 bp, Homo sapiens
acaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatggtaagggcacggctgtgggtcacttgcctgctcaaagccacccatgctcctgtccttggactcaggcctcacaggaagaccctaggctcctctggagaaaatggaaaaaaccagacccaggaaggaacactgaccctgatttgtccctgaccacccggctggtcctgagcacagggtgtccgaggcagtttacccacttctctgttctgggaaagctgggctccctacccttcctggctaggcacccatctcc

SEQ ID NO: 1552 - DNA, 1020 bp, Homo sapiens
acagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtgagtttctgggctctcgagagcgctggactcccggcggaaaggaggctgccccggctgcagctccgggggctccgggggctccaggggctccaggactcggttctcaccgcaagggctcctgcggggcccatcaacttcgccgctgggacgccgggctcggggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctctt

SEQ ID NO: 1553 - DNA, 3157 bp, Homo sapiens
actgcgctcaagtggacggtcgcgcgtgcagagggaggccggatagcagaccccacaacgtggctcctggggccccgctatcgagagctcaggccccgcgggcacttgcctaggagaggaaagaatcttcccaaagtgcagacagagacggaatttaatcaggagtcccagacttggagtttggaggcatgggctctggtgtcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagag

SEQ ID NO: 1554 - DNA, 689 bp, Homo sapiens
ctttcgctctgctgtgtccgtagcacatggcaggtacttggcccatcaagagtgagagagggtgagcgagtgagtgagtcaccggcttggcgagggtctcctctgacccacttagccttgccagcgctcagaactgccagccctgctgggtgcttgggacttttcaaagccctgggaattctccaagggtccacagtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggac

SEQ ID NO: 1555 - DNA, 615 bp, Homo sapiens
atatctgatatgtgataccatatgggagcaggctctgaaagaacactacaagtagagaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgca

SEQ ID NO: 1556 - DNA, 583 bp, Homo sapiens
gttctgtacctcacttctgatttctgcaagtcacttcctttttttttttgtctataaatttgttctgtccacgaggcaaccctggagtctctctgaatctgctgtgattctgagggctgcccaatttgtgaatcgttcattgctcaattaaacttttttaaatttaatttggctgaagtttttcttttaacatggtgtcagaagcgggatccaaagtacagcttctagcgacccccaggagtactgagtgaacaagcaaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcat

SEQ ID NO: 1557 - DNA, 3105 bp, Homo sapiens
attcccattagccccgcccctttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctcct

SEQ ID NO: 1558 - DNA, 2343 bp, Homo sapiens
acagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccc

SEQ ID NO: 1559 - DNA, 2952 bp, Homo sapiens
attcccattagccccgcccctttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggagggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctcct

SEQ ID NO: 1560 - DNA, 2174 bp, Homo sapiens
agccccgcccctttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacct

SEQ ID NO: 1561 - DNA, 3337 bp, Homo sapiens
gcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatg

SEQ ID NO: 1562 - DNA, 3349 bp, Homo sapiens
gcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagc

SEQ ID NO: 1563 - DNA, 2018 bp, Homo sapiens
tcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctctt

SEQ ID NO: 1564 - DNA, 1572 bp, Homo sapiens
attggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaacc

SEQ ID NO: 1565 - DNA, 1779 bp, Homo sapiens
cagaggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaaa

SEQ ID NO: 1566 - DNA, 1772 bp, Homo sapiens
cagaggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagc

SEQ ID NO: 1567 - DNA, 1495 bp, Homo sapiens
cgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaaa

SEQ ID NO: 1568 - DNA, 985 bp, Homo sapiens
gccgggaaaggccctgccgcgagcacgctgccaagagcccccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccg

SEQ ID NO: 1569 - DNA, 1157 bp, Homo sapiens
gttggtctgggattgtgccatcagctttgcaagcaagcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaag

SEQ ID NO: 1570 - DNA, 1771 bp, Homo sapiens
gctttttagaacaatggcttagccaggagggtggtgctgggtttttctttatcggcttgggtgtggaatcgcggactgcgcccctccaatctgatctggagagtggctgactgcgtgtgcagagctctgggggtgttggtctgggattgtgccatcagctttgcaagcaagcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagc

SEQ ID NO: 1571 - DNA, 1926 bp, Homo sapiens
atcagctttgcaagcaagtaagggagcggaaaaggccgggaaaggccctgccgcgagcacgctgccaagagcccccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagc

SEQ ID NO: 1572 - DNA, 1602 bp, Homo sapiens
cagaggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactggctctcctggccctgggagaatcgctcctgcagccccagcccagccccactcctctgctga

SEQ ID NO: 1573 - DNA, 3928 bp, Homo sapiens
ccggggcgctctcagcaggatggccaacaccttccctccatccctacaccccgccgccccctggcccgtggccgcgctcggctcccgcactgctcactccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 1574 - DNA, 3828 bp, Homo sapiens
agtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaagaaataccaagctgtgctgaggagaaaggccctgttgatttttctggtagttcacagactgcgttggtccagtaagcagagatgaacaccagatttcaaaacccagccctgtctgttaagagtgaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 1575 - DNA, 3627 bp, Homo sapiens
ctttgggtcgagctcagtcctcccccggcgcctccgactggcagtgggactcagcgggcgtggaggtcgcggctgagcgagcgagccctgggcgagtgaattgtggctcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 1576 - DNA, 655 bp, Homo sapiens
gagtaacggacgtgcgaggatgatgcttgtgcaagaaggaaatgaccgctgtcccggctccgcgggagacgaaccccggcttcccgccctcagggactagctctccagggaactgggacgcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggt

SEQ ID NO: 1577 - DNA, 2649 bp, Homo sapiens
accccattgattaccccattgccaggcgtgggcacgggagttggtttgggagctgccagtctcctgggaggatcgcagtcagcagagcagggctgaggcctgggggtaggagcagagcctgcgcatctggaggcagcatgtccaagaaagggagtggaggtgcagcgaaggacccaggggcagagcccacgctgggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccacatcatcaaccagaaacagttccagcggctgcgggcattgctgggctgcagccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgccagggctgcaaagcaaggtcttgcttctatctgggggacgctgctcgagagaggccaagaggccgcagaacatgccaggtgtcctcactcaccccaccctccccaattccagccctttgccctctcggtcagggttggccagacccagtcacaggggcagtgtcaccctggaaaatacagtgccctgccttcttaggggcatcagccctgaacggttgagagcgtggagccctccaggcctttgctctcccctctaggcacacgcgcacttccatctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctgg

SEQ ID NO: 1578 - DNA, 726 bp, Homo sapiens
agacaccgagcagctataggtcctggcagtgagacaagggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggc

SEQ ID NO: 1579 - DNA, 561 bp, Homo sapiens
gagctgggatggtgggcagcagggtcacccgaggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagct

SEQ ID NO: 1580 - DNA, 2480 bp, Homo sapiens
ggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccacatcatcaaccagaaacagttccagcggctgcgggcattgctgggctgcagccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgccagggctgcaaagcaaggtcttgcttctatctgggggacgctgctcgagagaggccaagaggccgcagaacatgccaggtgtcctcactcaccccaccctccccaattccagccctttgccctctcggtcagggttggccagacccagtcacaggggcagtgtcaccctggaaaatacagtgccctgccttcttaggggcatcagccctgaacggttgagagcgtggagccctccaggcctttgctctcccctctaggcacacgcgcacttccatctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctgga

SEQ ID NO: 1581 - DNA, 2122 bp, Homo sapiens
tccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 1582 - DNA, 785 bp, Homo sapiens
cccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgcttcgagagggagttgtgactctgcctctttgccagatgacaaaactgagacacacagccgtgacttacttggcaagactgagtgactag

SEQ ID NO: 1583 - DNA, 3074 bp, Homo sapiens
cccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 1584 - DNA, 3363 bp, Homo sapiens
gggaaaacgcatgcatttcaggacttcgctttcgggttcccttgtcctgtgttgtgtaatgcccccgttatggcactagaaatattttttattagccgaagctaaatatagtgggactttggctgatcccgagctcggaggacagccggggtgatccgtttccccccgaggatcgaggtggtgcgctctggacggggttgtgcattctcgccgcgcccgggcggacgatccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 1585 - DNA, 844 bp, Homo sapiens
aatgcccccgttatggcactagaaatattttttattagccgaagctaaatatagtgggactttggctgatcccgagctcggaggacagccggggtgatccgtttccccccgaggatcgaggtggtgcgctctggacggggttgtgcattctcgccgcgcccgggcggacgatccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatggtgagatgtgggc

SEQ ID NO: 1586 - DNA, 485 bp, Homo sapiens
aacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgcttcgagagggagttgtgactctgcctctttgccagatgacaaaactgagacacacagccgtgacttacttggcaagactgagtgactagtaaataaatgatggagcagagaa

SEQ ID NO: 1587 - DNA, 3241 bp, Homo sapiens
gtgccaaggggatctcagctggttcacattctgagactgtgttctggaatgtgctgccctttcagcttagagagaggagtttgggtctttttgggataaagcctgccttgtgggagaagaaagggagagtaacgctttgcatgtggaaaatacttcaacgtggttttgcatctgtgtgtttaaacttcaaacaaccgccctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 1588 - DNA, 2957 bp, Homo sapiens
ccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 1589 - DNA, 2266 bp, Homo sapiens
gtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgaggtaaatcagggatttcttcttgatttggatccattgttgcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacct

SEQ ID NO: 1590 - DNA, 5248 bp, Homo sapiens
tgtggctctgcaaccttccgccagctcccacgctttccccgcgcgtccccggcgcctcctcgctcctcttgcttccccgcgacccctgcgttcccgtgcgcgcgcgcccgcttgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgta

SEQ ID NO: 1591 - DNA, 1945 bp, Homo sapiens
tgtggctctgcaaccttccgccagctcccacgctttccccgcgcgtccccgcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttc

SEQ ID NO: 1592 - DNA, 5499 bp, Homo sapiens
ccaatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggttcaagcgattctcctgcctcagcccccctagtagctgggattacaggcatgcgccaccacacccagctaattttgtatttttagtagagacggggtttctccgtgttggtcaggctggtctcgaactcctgacctcaggtgatccgcctgcctcggcctcccaaagtgctgggattacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatggcgtgatcttggctcactgcaacctctgcctcccgggttcaagcaattctcctgcctcagcctcctgagtagctgggatttcaggcatacgccaccatgcctggctaattttgtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctactgggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattacaggtgcatgcccccacacccggataattttttgtacttttagtagagacagggtttcaccatgttagccaggatggtctcaatctcctgacctaatgatccgcccacctcggcctcccaaagtgctgggattacaggcgtgaaccaccgcacctggccctggtagtgatatttaatccaatccaacaactataggctgggttaaataaaaggtcattattgtctatattccaagtggaattaaatgtagtcacagagattcctaacattttccttatatttaagggaaatcacttctaaaaaaacacactaatcagaactgtgatgctctaattagaaacaactcatctggccaactatttgctgctcagagtttcttatttcttagatgaaaaaaactcatcagttatattcatgtgatcgcggctaaaaagtcagtattttctttttgttctaatgtggcttcatttgaaatttctcagattctacattgtactaattatgaataacaaattataaattaaaaactcttaaagagaaaaacttggcttaaaaaaatcatttcatatctccttataagcctttgtcctctaggttgtaatgactctgacttcccacctgtgatggaaagctaagagtcacaaggtcactatgtttactcttacgtaaaagatagtacacattttggctaggctgtttacttcaaaaggcaacctataggtttctacacaaaaagaggcacacatttgcatttgcattagtataatatgcatttgtacggatattgctttaaaaatttatgtaatctactaatgctatttattactcattccactgatccctgaagtctctcaactagtagagaaaataaccgtgatttagcaagaagcgacatggggaagggtgacaacaatatacattgtttgattagatacagactccttactgtgtcagactcctgaggttcttttggaatagtgggtagcaccacttcaccagaagagtctgatattgcaatttgctgggtgatgaagattttatcttgaagcttactttcatccctgcaataatgacaaaataacagaaccgtcaacaactctacacacatgaaacctggtttagaataacagacttgtcatattactttcaattagcacattcaagatgcccacaagaaccatcgtgttgggctcatgtttattacttaagcaagagagctcttacccaaattcctttgtttccccactgtcagaaacaacatagtctggaactggaggcctagaactctggttgtatttcctgtagtgggtaaaagtcaacaaagataatgaatgaggcagtgtctcctcatgcct

SEQ ID NO: 1593 - DNA, 4964 bp, Homo sapiens
accagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcccgtgcagagttgtatagaaaatgcgtctggaggctgggcaaggtggcttacgcctataatcccagcactttgagaggccgaggcgggtggatcagtagaggctaggagtttgagaccagcctggccgatatcgtgaaaccccgtctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaattttttttggttataatgttcattaaaacatatgccttcaatttgttcctctttgttcttttttgctgatttagcagatataaatcacttgttagtatttttaactatccaagttaaaatgtacatttgtaagtgttattactggtcttatatttgaaggtgcaaggggtcttgtgctgctcattactggttatcttgagcatttcataactgctgcctcctcctaaatcctgtgttccaaccgctactgctggcaatgcccagcctccattgtggatgcggggaattgtgttcagcatgcttgcttctgccacggcactaaagcctaacttgcttaggatcttgctgtacttggagagagcatccattcgctgagcctagcagccaggctcttgtgactccctgggaagtgggtgaagacctggctcctggctgcagcagtgaggaggcaggccctccaggtgaagacttctcacaatggagggaaggcagttttctcaaaggaaattgagtgctattatgtactctgcttcctactttctctttcagggtgggaatctgttaagcctcctctctctcttgctctgcaaccacagaacacttctttttttttggtgtctcagttttgcccacactggagtgcagtggtgcaatagtggctcactgcagcctccaactcctgggctcaatctatccttccacctcatgctccccagtagctgggactacaggtgcatgccactgtgcccagctgattattatttttttttgtaaagattgggtcatactacattgctcatgctcgtcttgaacttgtggcctcaagcgatcctcctgcctcagcctcttgagttgttgggattacaggagtgtgccaccatgcccagctctgtggaaaattctctgtggcattctgtctcctgaaaatgctgaagggaccaagagggctctgtgtccttcctcttctcttccctggcactttcagaccattttcttgttgccttcattctaacaaaggttgcagattggaaagctgatttggaatgctttttaagtgttttcagtttcaatatttttatgaaattcctatggtctccaacaaacttttttttttttttttttttctacacctggagcttatcctgcagaagcttcctgccaatgattgttttggaggaaattaaaagaaaaccaaacgaaacctctcctatccaaggggaagaactttatccccatattgattgaatataggattctagatttaaaatgttgtaggcagttagagtttgctctttttttttttctattggaaaggtccacaaatgttttattgacatttttgtctttaatccatttggatttggggtacatgttacgatttgtctacgttaatttcccttttaaaaataaaaataattcctcaactccaa

SEQ ID NO: 1594 - DNA, 1252 bp, Homo sapiens
atgtggcgccttcctcgcgcgctgtgtgtgcacgctgcaaagaccagcaagctctctggaccttggagcaggcctgccgccttcatgtccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttact

SEQ ID NO: 1595 - DNA, 1935 bp, Homo sapiens
aggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagataca

SEQ ID NO: 1596 - DNA, 1587 bp, Homo sapiens
gtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccagggtgaaatctgtctctgtaccagcaggatctttgtccagaagagcatctatagtgaatttttaaagagatttgtagaagctaccagaaagtggaaagtcggcattccctctgatccactggtgagcataggtgctctgataagtaaagcacatttggagaaagtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcagttgttcaatgtggtagatgaaaatcatggcatgaattccagctatgccttgacttggcagaaggttatctctagcttatcctcagttcttagtaactttacccactagtgaagagatactgtctattttcaatgtggactcggaaaaaaagacttataagtaggaagatagaacaatgatgccagttgtca

SEQ ID NO: 1597 - DNA, 2558 bp, Homo sapiens
agtccagacagtggtggggacaacctgagtgctcagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccagggtgaaatctgtctctgtaccagcaggatctttgtccagaagagcatctatagtgaatttttaaagagatttgtagaagctaccagaaagtggaaagtcggcattccctctgatccactggtgagcataggtgctctgataagtaaagcacatttggagaaagtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcagttgttcaatgtggtagatgaaaatcatggcatgaattccagctatgccttgacttggcagaaggttatctctagcttatcctcagttcttagtaactttacccactagtgaagagatactgtctattttcaatgtggactcggaaaaaaagacttataagtaggaagatagaacaatgatgccagttgtcaggctcctcccaggttatgttttcatagtgtttctttcatcatcttcattgaactcttgggaatctccagataatcagattatttcatttggtaaattttaaaaaatatgcaatcaggcacagtgcctcatgcctataatcccagcactttgggaggccaaggtgggtggatcacttgagttcaggagttcgagatcagcctaggcaacatggtgaaatcctgtctttaccaaaagtttaaaaattagcttggtgtggtgccctctgcctatagccccagctacttgggaggctgaggtgggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaaccagta

SEQ ID NO: 1598 - DNA, 2383 bp, Homo sapiens
acagtggtggggacaacctgagtgctcagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccaggtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcagttgttcaatgtggtagatgaaaatcatggcatgaattccagctatgccttgacttggcagaaggttatctctagcttatcctcagttcttagtaactttacccactagtgaagagatactgtctattttcaatgtggactcggaaaaaaagacttataagtaggaagatagaacaatgatgccagttgtcaggctcctcccaggttatgttttcatagtgtttctttcatcatcttcattgaactcttgggaatctccagataatcagattatttcatttggtaaattttaaaaaatatgcaatcaggcacagtgcctcatgcctataatcccagcactttgggaggccaaggtgggtggatcacttgagttcaggagttcgagatcagcctaggcaacatggtgaaatcctgtctttaccaaaagtttaaaaattagcttggtgtggtgccctctgcctatagccccagctacttgggaggctgaggtgggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaa

SEQ ID NO: 1599 - DNA, 2696 bp, Homo sapiens
ggatcctaggatgcttacatgcaatgatgaacccgaaaacacttgcaaagtgctacgcaaatattgatcacgaagaaggaagtcctcttcccgcctggagactgtgtggggtatggcggggtggtggggagaatgtggtgtcttgctccaccctcctggcgaggggagggcctggcctggaccgcagaggaatcgagtgactgcccctaaaatctcctagaaccgatcccgcggccccgcccctcccgcggccccgcccctcccgcggcccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgtt

SEQ ID NO: 1600 - DNA, 1674 bp, Homo sapiens
gtttcctgtgttctgcagcgttgacttgagcacaagacagtgacagtggagagtctaaggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaa

SEQ ID NO: 1601 - DNA, 5070 bp, Homo sapiens
acatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatatccgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatggg

SEQ ID NO: 1602 - DNA, 581 bp, Homo sapiens
tttgagcagtgactgggatgcagtgaggagcaagccatgcaaacatctggggagacagcatccaggcagtgggaatggcaggtgcaaaggtcctgaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatg

SEQ ID NO: 1603 - DNA, 2234 bp, Homo sapiens
aaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcagatctttgacttttctctcactgaagaagaaatgaaggacattgaagccttgaataaaaatgtccgctttgtagaattgctcatgtggcgcgatcatcctgaatacccatttcatgatgaatactgactgcagggagttcctgaacagatttttcactcccacgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttaacaggacaacgaagtgcatgtggcagtgtgctggcagtggccttgaggctttggaccattggttacaaaacagacacagccaagataagatccacacacacattattaacaaggaagtgatttgctgcaccttgagttgagagggctacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagt

SEQ ID NO: 1604 - DNA, 1236 bp, Homo sapiens
tttctttgatggaataggccctaggacacctttctaaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcaggtggcgcgatcatcctgaatacccatttcatgatgaatactgactgcagggagttcctgaacagatttttcactcccacgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagat

SEQ ID NO: 1605 - DNA, 1166 bp, Homo sapiens
acttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 1606 - DNA, 1818 bp, Homo sapiens
tcttggtgttgcagctgctctctgggcctcagtttgcttgaactaaatgtaacggggccaacttaggtgaactttgggaatccagccaacctgactttagggagagtatggagccacggatggcattgtgaatccggagggccgacaccagaagaacctgcaacgtggcatctgctaccttacttcccccggaaaagcgcctgcggcggcgcctaggcgcgcggtgcaatgtgggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 1607 - DNA, 840 bp, Homo sapiens
cccttgcaccgcccacgtggccagcgccacctgcctcattgtgcccaggagttctccaaacccgcgctgcggagtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctgga

SEQ ID NO: 1608 - DNA, 1384 bp, Homo sapiens
gacctcacgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaa

SEQ ID NO: 1609 - DNA, 858 bp, Homo sapiens
tgaagattgattgcaatgggagtggtttctctgtttctttgtatagtcgaacagatatttacttcttccaagaagatacaattcagaggaatttttatggcaaaagttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtgattccaggcctccttgatcaaattgactgtccccaaatgttacacacatttcagcattaaagttactacacttttcccagtaaattacatttttttgttttattttatgttttaaaacttagagtcaatcagtgaagatctacagtggaaatacatatgtataaaattagtgaatttggtataatgatacggtgctgtgataatttaataaaagcattgagaaatt

SEQ ID NO: 1610 - DNA, 3389 bp, Homo sapiens
ttttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgaacattatatcttgctcataaaagaaaactttccacattgttttaacaaaccccacagctgagagtcaggcctgaatctttgatgtgtgcccattcacaacgttgaccctattggtttgtggtggggcagggcatcaaagacatcattgactaatcacattcccctgaatagctcatatttagaaaatattcttagattctaaaaatgtactattaatttgtgatattcagtcttttaaatattttatacattaaacaggcatagttacaaatataaaacaaaaatatcccaaagccattatgcatggcactcaagattaaaatgggaaataatacatctaataaatcaaatgttccaagacttcaaaggtcttttggaaacaggctatgtaaaacagcacactggtttcaaactttggtaaattttaagaacaactcttacaaaggcatttaattcttatacataattttcaggggacctaagttaatcagctaatcatgaagacatgattttcattttagaaaacacttttgaaaacttgggataatctcatgccttaatgatcaaagcattatgagaaggacagtggtttttaacctgggcatatgttctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaagttagtagtgaagtgtgtaacgcttaagcaaactttcatatttcaaatctctttagcaagtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaa

SEQ ID NO: 1611 - DNA, 2021 bp, Homo sapiens
agaaagccatgtaaccatgaaggcagagattgaagtgattcaactataagccaaggcatgccaactgctactgggagccaccaaaagctagtcaaaggcaagggaaccatcttcccgagagctttcatggggagcatggccctataaacaactggatttttgactcaagtctccagaactggaagagaatacaatcctcttttgttgttctaaaccatccaatttgcacaaaaacgtgttttgaacctactctaaccaactgtcaaaaggctgtgttaagtgattctctgacaagaaccgggatttagctgaactaagaagcaaaaattctgcatcattttggtggcgtgtacagggacatgaggaaggaaccttggccattctgatgtttaaccaagagttgagctgagtggctctgaccagcgtggaagatgagagcagcctgaacttacactgtgaaaatgccctggagaaatgcagagatgcaggtttaatgaagtccatcagggtgtccagtttcaatcactaactgttggaactgatcctcagacaagccaggactcaagtacaagcccatctacaaccagatgagcccttagggccactggggccatttctgactttgtgctcttcacacacttccttacattagaataatgtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcct

SEQ ID NO: 1612 - DNA, 744 bp, Homo sapiens
attcgaaatatcagtgtgtgaagctgaatgatggtcacttcatgcctgtcctgggatttggcacctatgcgcctgcagaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 1613 - DNA, 3381 bp, Homo sapiens
ttttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgatcattatatcttgttcataaaagaaaactttccacattgttttaacaaaccccacagctgagagtcaggcctgaatctttgatgtgtgcccattcacaacgttgaccctattggtttgtggtggggcaggacatcgaagatatcattgactcatcacattcccctgaatagctcatatttagaaaatattcttagattgtaaaaatgtactgttcatttgttatatgcaatcttttaaatgttttatactttaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggaactaatcaaatcagctaatcatgaagacatgattttcgttttagaaaacacttttgaaaacttgggataatctcatgtcttaatgatcaaagcattatgagaaggacagtggttttttacctgggcacactttctaacacatttactctccactattcgtactctggtagccatgttaaccccatcagagattccttctcaagccatgtctcagagctgataggcatcccagcaagttttgcagctcacaatttttctgtaaattacttattctataaaattggaagaggccataaactttggagggccctagaccaattttttggattatttctggtctactctcattccgttgatgatcttagatattctctgcattaaatatcacctctaggctgagaaatccaccaaaaaatatttctagctcagcgttttcctccaaatcttcaatggaagatcataatgtgaactctgcatctccatgttaaagtttaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaacttcgtagccaagtgtgtaacgcttaagcagactttcatatttcaaatctctatagcacgtgtaactcttttttcaagatgtgaaataatcattaggtcagtcatttgtaaatagtacggctgctgtgggctttttccagttcttcaccatccatttttataaaactcttattgttaaaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaa

SEQ ID NO: 1614 - DNA, 1589 bp, Homo sapiens
gagatctggttgtttgaaagtgtgtagcacctccaccttctctctctctctccctctccctctcctgccagccaagtgaagacatgcttacttccccttcaccttccttcatgatgttaccattggaatgacatactgcatcctatagttataccatccactctgaaatcaatgtgaatttaacttcagttccatacagaaacttcttttccacaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 1615 - DNA, 1478 bp, Homo sapiens
gctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggtta

SEQ ID NO: 1616 - DNA, 945 bp, Homo sapiens
atttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtccagaaaacctgctgcacatagggtgcacaatgagtttccatcttcttgcctcttttcaaggggcaagaactcagtccgggaatgtcttaaactacaaaccttcatgggaaaccttgttgcttctgcttcctctcttttcacactggaggttttatttttgcttagccatgaattcttgtgtcattcataacttttgtcttaaggtactgaaaactagtcaggctagttaatgcaaaagggtatattagatatgataatgggaaatcaaagccagggctacattaagaa

SEQ ID NO: 1617 - DNA, 1807 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctgcccattgtttttgtaatctctgaggagaagcagcagcaaacatttgctagtcagacaagtgacagggaatggattccaaacaccagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataa

SEQ ID NO: 1618 - DNA, 1262 bp, Homo sapiens
aacatgttccttgaggttgaagcaaatctgaccgattttcaatgtaaaaataacatataaaaactgttctcggagttatttctaaacagaactaagatcagaattctttgaatcatcagaatcatctcttttgaaaaatcgattcatcaaatgaatcttcagccaacaactgttcaagaaggatgcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttg

SEQ ID NO: 1619 - DNA, 1194 bp, Homo sapiens
acaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaa

SEQ ID NO: 1620 - DNA, 1414 bp, Homo sapiens
aggaagaagtgaatagaagaaaagagggtgttgcaaatcaaaagcacatagagatatcatcttacaccagtcagaatggctattcttaaaatgtcagacaacaacagatattggattgccacatcatcaggaccacaccttcatcaggaatgaatattcctactacaattaaagaagaaacaaaattaatttgttggtgaaaaacatgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaa

SEQ ID NO: 1621 - DNA, 411 bp, Homo sapiens
acaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagagtacaacc

SEQ ID NO: 1622 - DNA, 2347 bp, Homo sapiens
cctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcagatctttgacttttctctcactgaagaagaaatgaaggacattgaagccttgaataaaaatgtccgctttgtagaattgctcatgtggcgcgatcatcctgaatacccatttcatgatgaatactgactgcagggagttcctgaacagatttttcactcccacgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttaacaggacaacgaagtgcatgtggcagtgtgctggcagtggccttgaggctttggaccattggttacaaaacagacacagccaagataagatccacacacacattattaacaaggaagtgatttgctgcaccttgagttgagagggctacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagt

SEQ ID NO: 1623 - DNA, 1208 bp, Homo sapiens
aatagagggcttgggtccggaagtgatggactggaggcttgactaatgtgaaaggggcgtctgaaagagaagccagctgccatgccatgaactgcaatgtgaaaaggccaatgtagcaaggatatgtccagccaacagccagtgaggatctgaggccctcagaccagcagcccatgagcaactgaattttgctaataaccatgtaagtgaacacagaagtggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctggaggcagctccataaacttgccttgcttgatcttcccatactacgagtaactctccattcagtgcatactctgcactcagagaaactggttacaggtgacctgcagtgtcctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcagatctttgacttttctctcactgaagaagaaatgaaggacattgaagccttgaataaaaatgtccgctttgtagaattgctcatgtggcgcgatcatcctgaatacccatttcatgatgaatactgactgcagggagttcctgaacagatttttcactcccacgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataac

SEQ ID NO: 1624 - DNA, 1957 bp, Homo sapiens
cttatttggcagctgctgcctcacccacagcttttgatatctaggaggactcttctctcccaaactacctgtcaccatggcccaccgatttccagccctcacccaggagcagaagaaggacagccagggaaagctgttcagaaacatcctcaaggaaaaggggatcgtggtgggaatcaagttagaccaaggaggtgctcctcttgcaggaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgat

SEQ ID NO: 1625 - DNA, 2451 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgat

SEQ ID NO: 1626 - DNA, 1033 bp, Homo sapiens
atctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctctggggtggcaaggctgcaaacaaggaggcaacccaggaggcttttatga

SEQ ID NO: 1627 - DNA, 1652 bp, Homo sapiens
cccggaggagtcacgtagctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 1628 - DNA, 1708 bp, Homo sapiens
cccggaggagtcacgtagctctgcgacatccgcagcctcatttaccagagggagccagggctgcagcctcatctgtttgcggatcagaacccgagctgtgcttgtggctgcggctgctaactggctgcgcacagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 1629 - DNA, 579 bp, Homo sapiens
agtctcatctctctctcaggctctctactcctttcagccttggtcctctgccctcccgtctgggtgtctgagttgtggggaattgaagtgcttcctattgctatcctcctgccaaacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgct

SEQ ID NO: 1630 - DNA, 1088 bp, Homo sapiens
cctcatcagggcccagccttcccaagctcgccttctctctgccgggcgcagccggctggtggtggccactgagacaagatgcctagcatcttcgcctatcagagctccgaggtggactggtgtgagagcaacttccagtactcggagctggtggccgagttctacaacacgttctccaatatccccttcttcatcttcgggccactgatgatgctcctgatgcacccgtatgcccagaagcgctcccgctacatttacgttgtctgggtcctcttcatgatcataggcctgttctccatgtatttccacatgacgctcagcttcctgggccagctgctggacgagatcgccatcctgtggctcctgggcagtggctatagcatatggatgccccgctgctatttcccctccttccttggggggaacaggtcccagttcatccgcctggtcttcatcaccactgtggtcagcacccttctgtccttcctgcggcccacggtcaacgcctacgccctcaacagcattgccctgcacattctctacatcgtgtgccaggagtacaggaagaccagcaataaggagcttcggcacctgattgaggtctccgtggttttatgggctgttgctctgaccagctggatcagtgaccgtctgctttgcagcttctggcagaggattcatttcttctatctgcacagcatctggcatgtgctcatcagcatcaccttcccttatggcatggtcaccatggccttggtggatgccaactatgagatgccaggtgaaaccctcaaagtccgctactggcctcgggacagttggcccgtggggctgccctacgtggaaatccggggtgatgacaaggactgctgagacctgccagcctcttgactatccaaccacccaacaacttgcctgtgtcttgagaagatagccccggtcaggacttgcacctgcgggacactcgtggttccttcctctgtttccccttccgtgtcctccttgtcctgcgctgccctgccttgaggcagatgatggactttgtgacatctctgagcagcagcctggtgactgtggggggctgtctc

SEQ ID NO: 1631 - DNA, 2238 bp, Homo sapiens
agctgctccaatgccccggagtggccatgggcgccccgcactggtgggaccagctgcaggctggtagctcggaggtggactggtgcgaggacaactacaccatcgtgcctgctatcgccgagttctacaacacgatcagcaatgtcttatttttcattttaccgcccatctgcatgtgcttgtttcgtcagtatgcaacatgcttcaacagtggcatctacttaatctggactcttttggttgtagtgggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtgatggcaagatggtggctggcttctctgcttatcgcccctcatgcagtgggcttcctttgctaggaagacagccaagggagttcgaatagttggggtgtgggctatcttttcaaaaatctatttgctggggctcttaatttctttagtgttctttgtatgtagggatttaaactttgtcatatggtacaaatattccctgcccccctgcagtttcccatttgtctttcagtatgttaatatttttgtgccatactggttttaaactttcatgttgtcacatctgttaatcttttctttaggatttctggattttgtgtaatttttaaaaaggtcccctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatggcagagcagtcccttgggggatccagccctgtacaatgcatctcttcctggagaaagctggcctgctccagaccccaccattcccaggcgcccttggagtggactctactgatgacagacagaccctctgagagacaagaccctctgactctgtgatggaagatgccagagattttcctttggggtaattgtccttaaacaaaaccaaacagatgaaacacacacaggacttgtggctaaaaaggctagtttttcacttgcatttctcaactaacccaggttttacatgcatctgtgaatccttttactactacctctgtggagagatggagagacttcagataaacgtgaagctaatgagtaaaaccctctctgccaaaacctacactccactttaggcccttcttgaagatgagcacaatttttaaatactgagcacaatttttaaatactgacatcacttcctcttccccctcccaccccagctcagcagcctcaaatctacagagaagaagaattatggcatgaacattcccacagacccaccatctttaagacttgacctctgtaagtttaccaaagggctcctcacaattgtggtgggggttctggttcaaaatttggagcaaacatgaagtttttggaaacgttttctcatttgaagcctccagtatgctgtactattctggaaattaccttcaagagtctcacttcttgtttctgttgtgttttctgtgggcatcatgttcttcacgcttgcagtagaaggtgctttctcggtttcccagagtatccaacggctcacctttctcaagtgctggcagtagctatgcactcacgggctggtttgggtcgctggtgcagcagcgcaaatctgtt

SEQ ID NO: 1632 - DNA, 728 bp, Homo sapiens
gcggagcgcgggaggccagttgggaggcgcacatccggcggttacccggtgcttcataaagccgctttcgccgctggctgtcgccgcgttttgcctccgcagcagctctgggctcttctcagctgcgcgagcagctgctccaatgccccggagtggccatgggcgccccgcactggtgggaccagctgcaggctggtagctcggaggtggactggtgcgaggacaactacaccatcgtgcctgctatcgccgagttctacaacacgatcagcaatgtcttatttttcattttaccgcccatctgcatgtgcttgtttcgtcagtatgcaacatgcttcaacagtggcatctacttaatctggactcttttggttgtagtgggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggcatgagaggaaccagcgaaggagacacaggaaaggtggccagcaaggaggtggagacaaggtctga

SEQ ID NO: 1633 - DNA, 2550 bp, Homo sapiens
gatttaaacccaggcagcctgcgctgcagccggttcctggtgtccccacttcgcctccctcctgctgcccccaagacatgcaggggccctgggtgctgctgctgctgggcctgaggctacagctctccctgggcgtcatcccagctgaggaggagaacccggccttctggaaccgccaggcagctgaggccctggatgctgccaagaagctgcagcccatccagaaggtcgccaagaacctcatcctcttcctgggcgatgggttgggggtgcccacggtgacagccaccaggatcctaaaggggcagaagaatggcaaactggggcctgagacgcccctggccatggaccgcttcccatacctggctctgtccaagacatacaatgtggacagacaggtgccagacagcgcagccacagccacggcctacctgtgcggggtcaaggccaacttccagaccatcggcttgagtgcagccgcccgctttaaccagtgcaacacgacacgcggcaatgaggtcatctccgtgatgaaccgggccaagcaagcaggaaagtcagtaggagtggtgaccaccacacgggtgcagcacgcctcgccagccggcacctacgcacacacagtgaaccgcaactggtactcagatgctgacatgcctgcctcagcccgccaggaggggtgccaggacatcgccactcagctcatctccaacatggacattgacgtgatccttggcggaggccgcaagtacatgtttcccatggggaccccagaccctgagtacccagctgatgccagccagaatggaatcaggctggacgggaagaacctggtgcaggaatggctggcaaagcaccagggtgcctggtatgtgtggaaccgcactgagctcatgcaggcgtccctggaccagtctgtgacccatctcatgggcctctttgagcccggagacacgaaatatgagatccaccgagaccccacactggacccctccctgatggagatgacagaggctgccctgcgcctgctgagcaggaacccccgcggcttctacctctttgtggagggcggccgcatcgaccatggtcatcatgagggtgtggcttaccaggcactcactgaggcggtcatgttcgacgacgccattgagagggcgggccagctcaccagcgaggaggacacgctgaccctcgtcaccgctgaccactcccatgtcttctcctttggtggctacaccttgcgagggagctccatcttcgggttggcccccagcaaggctcaggacagcaaagcctacacgtccatcctgtacggcaatggcccgggctacgtgttcaactcaggcgtgcgaccagacgtgaatgagagcgagagcgggagccccgattaccagcagcaggcggcggtgcccctgtcgtccgagacccacggaggcgaagacgtggcggtgtttgcgcgcggcccgcaggcgcacctggtgcatggtgtgcaggagcagagcttcgtagcgcatgtcatggccttcgctgcctgtctggagccctacacggcctgcgacctggcgcctcccgcctgcaccaccgacgccgcgcacccagttgccgcgtcgctgccactgctggccgggaccctgctgctgctgggggcgtccgctgctccctgagtgccccactccggagttatcctgctccccacctccgggcgtcctgccctgttccccgtcctgagccgccacttccagcgaacacacacaggtgtcctgccgttggaccttcacctcctagagataaaccagcctcagctggcgcagcggggcccttcttccctccgcatccccttcagggagcaggagcccagggcgccctgggagctgagcctgggacttccaggacctcccctcaggttgttctctgattcttcctcccaaccccagagactgcagatttgtgccatgcggctgcctgcaccccagacaataaagggaccaaaaccacccaacccccaccctgcctctatcctaaggaagaccaagcaggcctggacccagagacgtcccccatcgtgggacacgacacacccagaccgcgtgccccaccgtcttagcttcaatcctggcagcacctggtagacccaaggacttgggtggatcaggacacctgaagaagagaagcttccggcaaccctgcaacccacccaaggaggctactggatcggggattcccaggggggctttgacacagtcctctgctgtctccccactaggatcattccacacccctgcacctgaccaagggaccaatgaggcagaggcttgccccaagtcacagccactcagatgcttcctgccccccagtgcccattccaggtcaccagatccaaggagcgcttgaggagctctgggtacagggcagcaacccagagcccatgggccctcccgggacatctggatgctgggcatagatttctcaacaaggaagactcccctgcctcctcaaggtctccattctcctaggagacaaagcaataataaaaggtgttagacaatgtaa

SEQ ID NO: 1634 - DNA, 1595 bp, Homo sapiens
aacagcccttgcccaccgcagttcctcatgttgccctgctaacatcggtatgtatacacacacatgcacacacgtgaacatgtttgcacatatgctccccacgcatacacacatgctcagcgcctccgccttccagaggtgagcgtccgccagcccagcttggctgctttcttgccaaaccccggggttcccactcgagcacagcggtcttggcctggccccgaacaggcctctgacgccaaggagccagccagaaaccagcggtggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaat

SEQ ID NO: 1635 - DNA, 733 bp, Homo sapiens
agcactcccacttcatctggaaccgcacggaactcctgacccttgacccccacaatgtggactacctattgggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggt

SEQ ID NO: 1636 - DNA, 2193 bp, Homo sapiens
agaaactcccggtgtggcagctgagatggcccaggaaagaactatattaccttcaaaaagagaggtacatgcgatgtttgaggtggcatgaagctcagtggtgttatattggaatgagtgagtgaccatcctggagccttcctgaaagaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgac

SEQ ID NO: 1637 - DNA, 2589 bp, Homo sapiens
tcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 1638 - DNA, 2336 bp, Homo sapiens
atgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgagg

SEQ ID NO: 1639 - DNA, 2312 bp, Homo sapiens
ccgggcctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcagagaaagagaaagaccccaagtactggcgagaccaagcgcaagagacactgaaatatgccctggagcttcagaagctcaacaccaacgtggctaagaatgtcatcatgttcctgggagatgacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgagg

SEQ ID NO: 1640 - DNA, 2428 bp, Homo sapiens
ccgggcctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgagg

SEQ ID NO: 1641 - DNA, 2971 bp, Homo sapiens
aataccgcacccttccctgggggacacctggtcccaacctgagctgcctttctcaggaccccagccccagcccggcccagcccagccacaccctgccactcccttcagccagtgtggcttcaggtcaagaggctgggcagggtcaaggtggcaacgaggggagaagccgggacacagttctccctgatttaaacccgggcagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctccgcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaa

SEQ ID NO: 1642 - DNA, 2493 bp, Homo sapiens
catactccatacctgggatttccgcctcgccgctctccgactgcttccagacatgcaggggccctgggtgctgctcctgctgggcctgaggctacagctctccctgggcatcatcccagttgaggaggagaacccggacttctggaaccgccaggcagccgaggccctgggtgccgccaagaagctgcagcctgcacagacagccgccaagaacctcatcatcttcctgggtgacgggatgggggtgtctacggtgacagctgccaggatcctaaaagggcagaagaaggacaaactggggcctgagaccttcctggccatggaccgcttcccgtacgtggctctgtccaagacatacagtgtagacaagcatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggaaagtcagtgggagtggtaaccaccacacgggtgcagcatgcctcgccagccggcgcctacgcccacacggtgaaccgcaactggtactcggatgccgacgtgcctgcctcggcccgccaggaggggtgccaggacatcgccacgcagctcatctccaacatggacattgatgtgatcctaggtggaggccgaaagtacatgtttcccatggggaccccagaccctgagtacccagatgactacagccaaggtgggaccaggctggacgggaagaatctggtgcaggaatggctggcgaagcaccagggtgcccggtacgtgtggaaccgcactgagctcctgcaggcttccctggacccgtctgtgacccatctcatgggtctctttgagcctggagacatgaaatacgagatccaccgagactccacactggacccctccctgatggagatgacagaggctgccctgctcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttacggagagcgagagcgggagccccgagtatcggcagcagtcagcagtgcccctggacggagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccgcgccggcaccaccgacgccgcgcacccggggccgtccgtggtccccgcgttgcttcctctgctggcagggaccttgctgctgctggggacggccactgctccctgagtgtcccgtccctggggctcctgcttccccatcccggagttcccctgctccccacctccagtcgtcctgccggacctccacctggagctgtcacccccggagtcgccacacagacgtcctgccatggaaccttcccctcccggtgcaccctggggaccgagcccttgacaccacgccctttgctttatcttgctcttgaaattttggccccaactccagggactggggatttgtgcctggcagctgcctgcatttcaggaaaagaggaggctcagaccatccagcccccgcccatatcctgaggtggatcaggcaggctctctccccggggacatgaggcacccatacctaggaccccctgcgccttttttagcttcagtcatggcagcacctgagggacacaaggacttgggtgcatcaggacgccttggagaagcgtggcttcctgccaccctgcaacccaccctcccagccaaggaggctgctgtggtggggatccccaggggggctttgacacagtcctctgctgtccctccactgggctaattctacacccctgtgcccctcctaggggcccatgagtcagagaggcttgccccaagtcacagccactcagatgttcgacgccccctaaggtccattccagcacccacctgagttccgaggagcacctgggaagctctgggtgcaggatagcagtccagagtccatggccccgcctaggccatctgggtgctgggcatggatttctcagcaaggaagactcattaccttccctccctgggcctccattcttctgggaaacacaaagcaataataaaaggaagtgttagacaatgtaa

SEQ ID NO: 1643 - DNA, 574 bp, Homo sapiens
aggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaatttt

SEQ ID NO: 1644 - DNA, 2594 bp, Homo sapiens
gggtataggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctgggtttatttttatcccaaaccccttcctcccaggttaccagtggcactgggtgaaacagtgccttaagttatattcccagaaacctaatgtatgtaacctggacaaacacatgtctaaagaagagacccaagatctgtgggaacagagcaaagagttcctgaggtataaagaagcgactaaacggagaccccgaagtttactggagaaactgcgttgggtgaccgtaggctaccattataactgggacagtaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaaattaaagatctatatctgtctttggggtttagtctatctgggattaaggtttttttttctgtttttctttgctgtattgttcatgctattgaagccctctagctgtttctgccctacaccattctgctgtgccctaagtattctttgtggctgtctcacagaagagagaacatttcttaatattccagtcactgctgttattgtctgagggtaggcagcttggaaaaatgtaggcaacaccaagttttaatctttatacccccaacaatttgactgactatatcatggtccaggttactttacatttctctggacctcggtttcctcatcataaaatgaagatactgtagactaccatcttcctaaagggatattggtatttgaaagagaattaagtgctcctttctacaaacatgatgtgccaaaattgttttattataagggctctttgaaacatcctaacttccttgtgtggaggactggctggaagcccatttggtacctactgtttgcaatgcatgttattaagtttacatgtctcctctgtcctgctctgccccttttttaaattactggcattgaatattgagttcatatggtaatagcagggtttttaaatgaataaaaattatggatttatctctta

SEQ ID NO: 1645 - DNA, 1028 bp, Homo sapiens
gtctttcccaccacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacag

SEQ ID NO: 1646 - DNA, 1197 bp, Homo sapiens
cgattcgctggggcgcgtctttcccaccacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagttt

SEQ ID NO: 1647 - DNA, 939 bp, Homo sapiens
ttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttt

SEQ ID NO: 1648 - DNA, 572 bp, Homo sapiens
tttcccaccacgaggccaccagggtgactgcgggattccgatctgcgccggagctgcgatgctagagcactcttgccacccccaccccacggacgtgttgcagtgatatcagaattttgcgatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggac

SEQ ID NO: 1649 - DNA, 1049 bp, Homo sapiens
gtctttcccaccacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggtcagttatgggtccttcctccttaaaggggtggacagttgactttgggcaaacctcttcgcctctgtgggcaacagtttccccttctgcaaaatgagggtttggattgtagtttctaagtttagctgtggcgtgcgaattcccaggaggtagttctttaaaaattcaggtgctcaggcgtggagtgcagacctctgggtttttgcaagctagccagctgattctgatgcacaggtggacgtgggagaccctggatcagattgtccctagggtcccttccggctttaacatcttctgtttcctttctaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacc

SEQ ID NO: 1650 - DNA, 845 bp, Homo sapiens
cgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggt

SEQ ID NO: 1651 - DNA, 1474 bp, Homo sapiens
ggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggactggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaa

SEQ ID NO: 1652 - DNA, 918 bp, Homo sapiens
gatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgaagagggtgtgtatgaaatcagcctgtcacccacaggtgtatctagggtctgtttgtatcctggctttgttgacgtgaaagaagctgactggatattggaacagctttgtcaagatgttccctggaaacagaggactggcatcagagaggattccatattgcaactaacctttaagaagtcagcacctgttagtggaaccgcgactgctccgcagagctgctggtatgagcgcccgtcgccaccccacatcccaggcccagccattctgacaagaactagactttgggctccttga

SEQ ID NO: 1653 - DNA, 842 bp, Homo sapiens
tgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaaggtgaagtcatttgccatgggccatgcagctgggaagtgacagatctggattcaaagcgagttctggctggcgccagagtccttgtattttacagcactggttctcaagctttatgtgcattaagaattcctgggttgagggtggcgttagttaacaaattctgggactctacaaattgagtagatctgggatggggctctggaatctattttcaacaattgttccctggcaaataacatatggctccccagtgaatggagcaagaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcag

SEQ ID NO: 1654 - DNA, 2105 bp, Homo sapiens
cccacggccgcgcctgcgcactggccacgcggacggcgcgatggcggcggctgccgccgagacccccgaagtccttcgggaatgcggttgcaagggcatccggacctgtctgatctgcgagcggcagcgcggcagtgacccgccctgggagctgcccccagcgaaaacataccgtttcatttactgctccgacaccggctgggccgtgggcacagaggagtctgactttgagggctgggccttccccttcccaggagtgatgctgatcgaggactttgtgacccgggaggaagaagccgagttggtgcggctcatggaccgtgacccctggaagctctcccagtctggacggaggaagcaggactatggccccaaagtcaactttcggaaacagaagctaaagaccgagggcttctgcggcctccccagcttcagccgggaggtggtgcggaggatgggcctctacccggggctggagggcttccggcccgtcgagcagtgcaacctggactactgccccgagcggggctctgccattgacccccacctggacgacgcctggctgtggggggagcggctggtcagcctcaacctcctgtcccccaccgtgctgtccatgtgtcgggaggcgcccgggagcctgctcctctgctcggccccgtcggctgccccggaggccttggtggacagcgtgatagcacccagccggtcggtgctatgccaggaggtggaggtggccatccccttacccgcccgctccctgctggtcctcaccggggcggcacggcaccagtggaagcatgccatccaccgcagacacatcgaggcccgccgcgtctgcgtcactttccgggagctgtcggctgagtttggccctggagggaggcagcaagagctgggccaggaactgctgcggatcgccctctccttccagggaagacccgtgtgaaccgcctccttggctccagacttgactgatcccgggattgaaatgaggagcacagaacagggcctcctgcaactcacggggtttcaagagaagatggctgacccctgatgctgtgagcagtgtgagccctgcccaggagcaggttttgatgggaacgtacctccaggcagcccccttccacctggaccgtggccacacttttttggttatttagtttgtcacagtcttggggacatgggatcatttgagcttaaaaaatactgggggccgggcacagtggctcacacctgtaatcctaacactttgggaggctgaggtgggcggatcacttgatgccaggagttcgagaccagcctggccaacacggtgaaaacccgtctctacaaaaactacaaaaattagccgggtgtggtgactcacagccgtaatcccagctactcgggaggctaaggtgggagaattgcttgaacctgggaggcggaggttgcagtgagccaagatcacgccactgcactccagcctcggtgacagagcaagactgttttgaaaaaaaaaaaaaatgggaacattttaaatgattttcacctttattatgcatctattttcatggggtttcccgatatctcactgtccagtcccttcatttggggaatgtgttggattagggaacagggttgaagatttgaagtttagactaaagagctgggaacagcttcagagtcaggctcagcctgactcatgcttgacacccccacgcccagggagggttgggggatgtgaggagggcagggaaatctgagagcctccttccagccccataacgctgttaacaagtaggaaaaattaaagctcccggccaggcgcggtgactcacacctgtaatccgagtactttgcggggctcaggtgggaggattgcttgaggccagcctgggcaacatagtgagacccccatctctacaaaaaatacaaacattagctgggcgtctgggcatggtggcacacacctgtagtcccagctactcgaaaggctgaggcgggaggatggctttaccaccatgtcaaggctgcagtgagctcatgatcataccactgcacttaacttggcaacagagcaagaccctgtccctaaaataaataaaaggaaaacaaaaaaa

SEQ ID NO: 1655 - DNA, 2068 bp, Homo sapiens
cggacgatgccgtgacgcggcacggcgacactgttggcaatatgagcgcacccctgtagagggagcccttcggtcctggaggcggcgcggcgtgaagacaggttgctatttgagagcgttcccttgaagcccctcagagagtgggggaggggcggcggacggcaagcggttcctgtctgcgcttgcgccggcgcctctgccgacccggcctgcacgcacgcgcatgcccgtagcgcgcggagccgcggtggccggcagcactgcgcgtgcgcggtgaggagcccgctaaggagcggcgctggcggacgtcgggctggctgcccgtgacgtcgtgcggagagctttaaagtgcgggccgggccgggcgtccgagggtctggtcgggagtcgggccgcgtctccgcagcagccctccgcggcatgaggcgctgccggcgcccctgccccgcgggacgtggagaaggtggaggaggaagaagccccgttgtcgccaccgttgcatgacccgccgctcctgaggccctaccccacgcccggaccctcgacgccccccgccgggtcccccactcacgcatgggggttcggcgctaaggacccccctccctccgggggccccggggcgcgtccccttagagccatgcccggctgccccgcccgccccggaggaccctagagcagcgtcgtgggggccatggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgggaactctggctcatccttacgtagttgcccctccttttgttttgagggttttgtttttgttcattggggggtttttgttttttgttttttgttttttttgattctatatatttttccttggttttgttgcctgttagggctgaagaatagaattggccaggacctaggttctcatattcttggtattcctcctggatggaaaggctgttggcatcaatag

SEQ ID NO: 1656 - DNA, 3012 bp, Homo sapiens
gaggcgctgccggcgcccctgccccgcgggacgtggagaaggtggaggaggaagaagccccgttgtcgccaccgttgcatgacccgccgctcctgaggccctaccccacgcccggaccctcgacgccccccgccgggtcccccactcacgcatgggggttcggcgctaaggacccccctccctccgggggccccggggcgcgtccccttagagccatgcccggctgccccgcccgccccggaggaccctagagcagcgtcgtgggggccatggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttagggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataaggaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctaatatattttgaaa

SEQ ID NO: 1657 - DNA, 1278 bp, Homo sapiens
ctggctgcccgtgacgtcgtgcggagagctttaaagtgcgggccgggccgggcgtccgagggtctggtcgggagtcgggccgcgtctccgcagcagccctccgcggcatgaggcgctgccggcgcccctgccccgcgggacgtggagaaggtggaggaggaagaagccccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcct

SEQ ID NO: 1658 - DNA, 903 bp, Homo sapiens
ggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaa

SEQ ID NO: 1659 - DNA, 973 bp, Homo sapiens
gcggaaatggctgggagggggatggggatgttgaatttggaaattggaggggacgctggtggacggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatc

SEQ ID NO: 1660 - DNA, 903 bp, Homo sapiens
tggggcggaaatggctgggagggggatggggatgttgaatttggaaattggaggggacgctggtggacggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacc

SEQ ID NO: 1661 - DNA, 1331 bp, Homo sapiens
gactccataaccgtggccttggccccagtccccctgacttccggacttcagaccagatactgcccatatccccttatgaagtcttggccaggcaacccctagggtgtacgttttctaatgattaaagaggcggtgctaagctgcagacggacttgcgactcagccactggtgtaagtcaggcgggaggtggcgcccaataagctcaagagaggaggcgggttctggaaaaaggccaatagcctgtgaaggcgagtctagcagcaaccaatagctatgagcgagaggcgggactctgagggaagtcaatcgctgccgcaggtaccgccaatggcttttggcgggggcgttccccaaccctgccctctctcatgaccccgctccgggattatggccgggactgggctgctggcgctgcggacgctgccagggcccagctgggtgcgaggctcgggcccttccgtgctgagccgcctgcaggacgcggccgtggtgcggcctggcttcctgagcacggcagaggaggagacgctgagccgagaactggagcccgagctgcgccgccgccgctacgaatacgatcactgggacgcggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaactgggacattgcagtggctgcttgctggggccgggatttgcaggggaacccaggatggcactggcccatagggagctccaggtgtggctggctggacacatggtcaaagtcacaaggccgggagagtggtgtcctttattgcactcactgctggtcgccccagcccactcccctcctcgttgtctctgcatccaggtctccaataaataagtcagccga

SEQ ID NO: 1662 - DNA, 2491 bp, Homo sapiens
gccttgccagctagggctgagaacctagggaaaggggatggatcccagaggcgcccttggtgcagtctgagtcttcctgtgctcttatttgagcaatccctgcgactcctggacctctgtgtttgctcatgtgaaatattaaaaattctgtagtgcagtcatcccttgttctccatgacatactgcaaagttgctgttccacagatgaagatcttgaaatggaatggctctaaaatagctcctttgaagggcctcagatattctttgttttgttaagccattttgatctgctgcttctgaaaatcaacacctagatcaggccagcatttctaattaacaagctggattattattattattttttttacctctcatctctctgctatgctgccagccagcctgcctgcctcactggccttacatcctatttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaaggaattcccgctcatattgatacacattccgcttttgaggatgagatcgtttctctcagtttggggtcagagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagttacccgttggtctgtgatagccagaggaaagagactcccccctcatttccagagagtgataaagaagcctcacggctggagcaagagtacgtccatcaggtttatgaagagattgctgggcacttcagcagcacaagacataccccttggccgcacattgtggagtttttgaaggctttgccaagtggttcaatagtggctgatattggatgtggtaatggaaagtatcttggcatcaataaggagttatatatgattggttgtgatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataa

SEQ ID NO: 1663 - DNA, 2114 bp, Homo sapiens
gtagtgcagttttctccaacatggccgcgcccaggggagatggcgtgcaagtatccgctgcggtgttctggtgctagagtggagaggctggcaaagaagaaggcacacgcatgtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaaggaattcccgctcatattgatacacattccgcttttgaggatgagatcgtttctctcagtttggggtcagagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagttacccgttggtctgtgatagccagaggaaagagactcccccctcatttccagagagtgataaagaagcctcacggctggagcaagagtacgtccatcaggtttatgaagagattgctgggcacttcagcagcacaagacataccccttggccgcacattgtggagtttttgaaggctttgccaagtggttcaatagtggctgatattggatgtggtaatggaaagtatcttggcatcaataaggagttatatatgattggttgtgatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctga

SEQ ID NO: 1664 - DNA, 4079 bp, Homo sapiens
aaatgtagtgcagttttctccaacatggccgcgcccaggggagatggcgtgcaagtatccgctgcggtgttctggtgctagagtggagaggctggcaaagaagaaggcacacgcatggtgagaatccggcctgagccgaagcggagtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaaggaattcccgctcatattgatacacattccgcttttgaggatgagatcgtttctctcagtttggggtcagagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagttacccgttggtctgtgatagccagaggaaagagactcccccctcatttccagagagtgataaagaagcctcacggctggagcaagagtacgtccatcaggtttatgaagagattgctgggcacttcagcagcacaagacataccccttggccgcacattgtggagtttttgaaggctttgccaagtggttcaatagtggctgatattggatgtggtaatggaaagtatcttggcatcaataaggagttatatatgattggttgtgatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataaattaattacccttttaattaaagagaaaacttgtgggaaagtaccaaaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcattgagcagggtgctaaaaacaacccaaatgtgctcctttaactcctttgtttaaatgacaaaagttagaatgtggtcactcagacctaactgtgcccttagagccaaagctgtggtgtcattattggttatttctagttgattcatagtttgtcccaatccaggttcaatcgggttatttttaagatctgtacaatattgcataatagtaacccagttaacttaccacttaggttagatttcctggaggaacaaaggtagaaattcaaccataggtcaaattatcacatagaaggaaaaggctttttttcaaagaaaaaattttttgaacactttactcccagtatgcattacttttgtagtagtaatgcttaagactgttttaaagaaaaattgctttctgtttaattaatgtttactgttattaatgctagtgatacttaatcttgaagcatcaagttttcagaaacctatagtgatcaataatgggtctcagatgagaggatgattatttttttcatggaatttcagtccaacatcctggtgtactggtccctctgggatgaatttataaggctcatgatataggaaaaggaatatagggctaaaaatagttttatttctgatataaattctggtacttgacaccaaagtttgaagtcaagtcatgccaataaattttaacatccaaatgaaatagatgattttctatgaagatgaaaaataccaaaattgactcaagaagggagagaaaatggaagatgttgaaaaatagcataggaattcagaactgggctctagaatcagatttcctgagagttgaattctagatctgccatttattagctgtgggattttgggcaaatttcttgactttctgtgcttcagttttcttagctgtaaaattggaagagttgttatgaaaattcactgaaagtatatttgtatacatcataggatagtgtaagaatatagtatggctttgagaaatgttcattattattactcccagaggagttttaggtattaagtgatgccaaatataatttgttaattgtataataaaaatctatattcttactgac

SEQ ID NO: 1665 - DNA, 2296 bp, Homo sapiens
agttttctccaacatggccgcgcccaggggagatggcgtgcaagtatccgctgcggtgttctggtgctagagtggagaggctggcaaagaagaaggcacacgcatggtgagaatccggcctgagccgaagcggagtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcattgagcagggtgctaaaaacaacccaaatgtgctcctttaactcctttgtttaaatgacaaaagttagaatgtggtcactcagacctaactgtgcccttagagccaaagctgtggtgtcattattggttatttctagttgattcatagtttgtcccaatccaggttcaatcgggttatttttaagatctgtacaatattgcataatagtaacccagttaacttaccacttaggttagatttcctggaggaacaaaggtagaaattcaaccataggtcaaattatcacatagaaggaaaaggctttttttcaaagaaaaaattttttgaacactttactcccagtatgcattacttttgtagtagtaatgcttaagactgttttaaagaaaaattgctttctgtttaattaatgtttactgttattaatgctagtgatacttaatcttgaagcatcaagttttcagaaacctatagtgatcaataatgggtctcagatgagaggatgattatttttttcatggaatttcagtccaacatcctggtgtactggtccctctgggatgaatttataaggctcatgatataggaaaaggaatatagggctaaaaatagttttatttctgatataaattctggtacttgacaccaaagtttgaagtcaagtcatgccaataaattttaacatccaaatgaaatagatgattttctatgaagatgaaaaataccaaaattgactcaagaagggagagaaaatggaagatgttgaaaaatagcatagga

SEQ ID NO: 1666 - DNA, 2475 bp, Homo sapiens
ctctctacacagaatcggctgttgagtgtgctctcagtggagctttggttttagctgttctctgacaaagagcttgttctgagctgcacatctcgtcctctttgttcagcctcaggcttcaagcattgaatcctaaatattctccagctgggaatcagacaagggcagaaatgaagaacccagaagcccagcaggatgtttcagtttcccagggatttcgcatgttgttttacacgatgaaacccagtgaaacttcattccaaacattagaagaggtgcctgattatgtaaaaaaggcaactccatttttcatttctttgatgctgcttgaacttgttgtcagctggattctcaaaggaaagccaccaggtcgcctggatgatgctttaacgtcaatctcagctggtgttctgtctcgacttccaagtctatttttcaggagcattgaactgaccagttatatttatatctgggagaactacaggctgttcaatttgccttgggattctccatggacttggtattcagccttcttaggagttgactttggctactactggttccatcgtatggctcatgaagttaatattatgtgggccggacaccaaacacatcatagttctgaagactataacttatccacagcactgagacagtctgtcctccagatatatacttcctggattttctactctcccctggccctcttcatacccccttcagtatatgctgttcatcttcaattcaatcttctttaccaattttggatccatacagaggtcatcaataaccttggtcctttggaactgattcttaatactcctagccatcatagggttcatcatggcagaaatcgttattgcatagacaaaaattatgctggtgttcttattatttgggataaaatttttgggacatttgaagcagaaaatgaaaaagttgtatatggcttaacacatcccattaatacatttgaaccaatcaaagtgcagttccatcacttattttccatatggactacattctgggccacacctggattcttcaataagttttctgtcatatttaagggaccgggatggggtccaggtaaaccaagacttggtctcagtgaagaaattccagaggtcaccggcaaagaagttcccttctcatcatcttcatctcagctattaaagatatatacagttgtacagtttgctctgatgttggcattttatgaagagacctttgcagatacagctgcactgtcgcaagttactctccttctgagggtttgcttcattatcctgaccttgacttccattggatttcttctggatcaaagacccaaggcagctattatggaaactctccgttgcttgatgttcttaatgctgtaccgatttggtcacctgaagcctcttgtcccttcattgtcatctgcttttgagattgttttttccatttgcattgctttctggggagttagaagcatgaaacaactcacctctcacccttggaaataacctgaatttgtacataattctcttcttttaatgagttgtccacacgcatattatgactgcatattaaaatgtaattattttatgtaatgcttatatgaactatttcttcaatgaaaagtaaaattacttatttactattgtttgcctttcacatttgttattttctattaaaaattaaagtcagttttggttacttcccccctttactacaattaaaaaaagatttcaaatataatgatgttatattaactgatagccttatatgacaagtataaaaagaagggatgaaacttaaaaacagtaaaaacaagaaggaatattgcctttacatcaatttgaaaacaatgtttcctttgatgtttgctaaaattatgcatagatacatgtttgtagtcataaaaatgtattacattggttgtcttcctaaggccacagttacctttgcaatccatataacctaagaagctgcattccagaaaaagacatcactgaggccaggcgcggtggctcacccctgtaatcccagcactttgtggggctgaggtgggcggatcatgaggtccagagatagagaccatcctggccaacatggtgaagtcctgtctctactaaaaatataaaaatttagctggacatggtggtgtgcgcctgtagtcccagctactctggaggctgaggcaggagaatcgcttgaacctgggaggcagaagttggagtgagtggagattgcaccactgcactccagcctgggcgacagagcgagactccgtctcaaagaaaaaagacatcactgaaagaaaaatgaacagaatttgtcagaattagttttttcaacaggttactttgtcatacatttctctaatatgcttggtcaatttgttttggcagactgggcagcatgcagcaattctgcattatttaaagttatcagaacaatgttaattctctaaataaaattacccaaggt

SEQ ID NO: 1667 - DNA, 7764 bp, Homo sapiens
gtgaagctccagacgcatggcacccgccgccaagtcgccgcggtggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaggtactaatgtctcactggaagtatatatatatatatatatatatgtatgcatgtgtgtgtgtgtatatatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggcttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatattttttttcttcaaagggagtgtgaagctgtttattcttttatttgcatatgagtttttcttttagttttagtttttcatgttcatatttccactgatttgaaaacacaaaatttatttttataattttgttgcttgtagcataatcaagtgcaaaatcaagtgcaacctacttgtgactaaatctctttggatttatagctgaggatattgttagctaggttttgtcaatccctaatcattttttaaaatcaatgctgtattcccaggaggctttgagactcctatgaacctgaagcactcccttttgaaccttggaagatcctcaaagagtgagcactcttgtgctcttctaatcataattaattccttaacaaatcagagtaaggaccactgacatatagaaccctcaagccaaagaaccatcacagaatttagtaactttagttctgtgaacatgaaaagatttcttttttggtttccaaaggagattatttatttttccacaaggaaaaacatcttgcagagactctgaattccaaatctgagtgagaaagaaaaggaaaaaaatctgtttcatggtggatttctaagcaacatatatacatgtttttaagacaaccttttgttggcagtgtttttcctgaacaccatatgcaccctaggaaacatgtttttcctttaatcttgttcacatatcagaaaaggacatgaaatgctcatactggcatacaagtttctataagtagttattttttgagctacttatactatatccccaaaagctcacagtgccttgttgggattttttttttccatgaactagccattattttaaatgagtgggagagggtaagtctttagacagaggtcattcagcagttcaagactattcctcttcaagaacatgtcaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagccctaagttgtggcttggtgggtttggcattgagcctcaagacactcactacattctttctggatgtttgctcacaggctccctgaggagcagaacctgtggagctggggagtgcgggtggtttctattcctaatattgtgtgtcagtcctttttcgtgtgatggtgccttcagaataacgaatatttctgttctggacaatgattaaatcttatgagaaatatatgtaggttatattaattcttgtccatttttgctaagcctgtgaaatactttggctctgatacaacttaacttgaataatatcttatcctgagtcttcctccaaggcagtacatattcctgccaggactgtagtaatcctttgggaactacatgtgagtaagcacttgtatgtaagccattatactgctgtaactaatgcatacaaacaattcttctctttacatttatagtctaaaaggggatatgcagtgggaaggaaaattcctgagagattccagcatagctttgtcaattccgactgagccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaataccacaaccacc

SEQ ID NO: 1668 - DNA, 1249 bp, Homo sapiens
aaagaagcggtgagtagcggtatgtggaaggagttagcgtcgagggaccaggccgggcctgtgctgcaggagggcacaggcgaggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggacataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgaga

SEQ ID NO: 1669 - DNA, 1446 bp, Homo sapiens
tatacattctctctgagctggcactcaagcaccgtgggaccttggctggcttctggggagcaagagatccatttatgaatacttgatttctgactgctgggaagcacggctgatgctccgaaggagggaagactgacccggtttctggacttcacccagctgatggacatggcatctgaatccgtaggaggaaaaattttatttgcaacagatgacttttttgctcctgcagaaaacctcataaagagtgacagcccgtgcttcaaagagcatgaatatacggagtttgggaaatggatggatggctgggagaccaggaggaaaaggattccaggtcacgactggtgtgtcctcaggctggggatccaaggagtcatccggggcttcgacgtggacgtttcttacttcacgggagattacgctcctcgagtgtccattcaagcagcaaacttggaagaagataaactaccagaaatcccagaaagaggaaccaggacaggagctgcagccactcctgaggagtttgaagccattgctgagctaaaatccgacgactggagttacttggttcccatgactgagcttaagccaggaaaccctgcttccggccacaactattttcttgtcaattcccagcagagatggactcatatcagactcaacattttcccagatggtggaattgcacgacttagagtattcggtactggacaaaaagactggactgcaactgaccccaaagaacctgcagacctagtggccatcgcttttgggggtgtctgtgtaggatttagtaatgctaagtttgggcacccaaacaatataataggagttggcggggcaaagtctatggcggatggttgggaaactgcaagaaggctggaccggccaccaatattagaaaatgatgagaatggcattctcttggttccgggttgtgaatgggcagttttccgattggcacatcctggagtaataactcgaattgaaattgacacaaaatattttgaaggcaatgctcctgacagctgtaaagtggatgggtgcatcctgacaactcaggaagaagaagccgtgatcaggcaaaagtggattctcccggcccacaagtggaaaccactgcttccagtgaccaagttgtctcccaaccaaagtcatctgttcgatagcctgaccctagagctccaagatgtcatcactcacgccaggctcaccatcgtccccgacgggggagtgagccgccttcggctccggggcttccccagctccatctgcctcctgaggccccgggagaagcccatgttgaagttctcggtgagcttcaaagcaaacccttaacacacacaaagccccggtgtcggacacacagcagtaatttcccagtcatagtcttcttttcaaatgttttgaacacctggtgatttaataaagtggtcgtctcacaaa

SEQ ID NO: 1670 - DNA, 607 bp, Homo sapiens
gggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 1671 - DNA, 524 bp, Homo sapiens
ctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 1672 - DNA, 711 bp, Homo sapiens
ctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 1673 - DNA, 524 bp, Homo sapiens; identical to SEQ ID NO: 1671

SEQ ID NO: 1674 - DNA, 711 bp, Homo sapiens; identical to SEQ ID NO: 1672

SEQ ID NO: 1675 - DNA, 607 bp, Homo sapiens; identical to SEQ ID NO: 1670

SEQ ID NO: 1676 - DNA, 711 bp, Homo sapiens; identical to SEQ ID NO: 1672

SEQ ID NO: 1677 - DNA, 711 bp, Homo sapiens; identical to SEQ ID NO: 1672

SEQ ID NO: 1678 - DNA, 524 bp, Homo sapiens
ctccttccacgttgtctcctccacctagcagttggttggcaaccccttcctcagtccccggctgaaaaccctcgagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 1679 - DNA, 524 bp, Homo sapiens
ctccttccacgttgtctcctccacctagcagttggttggcaaccccttcctcagtccccggctgaaaaccctccagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 1680 - DNA, 607 bp, Homo sapiens; identical to SEQ ID NO: 1670

SEQ ID NO: 1681 - DNA, 524 bp, Homo sapiens; identical to SEQ ID NO: 1671

SEQ ID NO: 1682 - DNA, 524 bp, Homo sapiens; identical to SEQ ID NO: 1671

SEQ ID NO: 1683 - DNA, 711 bp, Homo sapiens; identical to SEQ ID NO: 1672

SEQ ID NO: 1684 - DNA, 607 bp, Homo sapiens; identical to SEQ ID NO: 1670

SEQ ID NO: 1685 - DNA, 711 bp, Homo sapiens; identical to SEQ ID NO: 1672

SEQ ID NO: 1686 - DNA, 607 bp, Homo sapiens; identical to SEQ ID NO: 1670

SEQ ID NO: 1687 - DNA, 607 bp, Homo sapiens; identical to SEQ ID NO: 1670

SEQ ID NO: 1688 - DNA, 657 bp, Homo sapiens
ggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctcc

SEQ ID NO: 1689 - DNA, 2020 bp, Homo sapiens
agatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctgaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 1690 - DNA, 1935 bp, Homo sapiens
agatggatttgcagccgctgcaagtgtgtggaagggccgtgttcgtgttggcaaagaagaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtc

SEQ ID NO: 1691 - DNA, 2321 bp, Homo sapiens
tgcacttctgtgcctcaatttcctcatctgtagggtgggggtggtgattgccaccccatagggtggttataaggggccacacatgttcctatgtgtgagatgctgagaaagtcacctggcatggacaggatggacagccagtatttatcgaactatgaatgaatgaatgttaccctttagtgggttccagcgtcctatcctgtcggtgggaagactgaggctcagagagctccgtaacttgccccaggtcacacagccggttcaggcagagttggggtctcatgcctcccaggtgttcccacagtcttttccccaggagcagggtccaagcctgctgctcctccaaccacctgcgaggcacctgggcatgttcctggccaccaggaaagagaggtctaatggcagtagtaccagtcagcgtcatgtgcctggagcgagtgccctaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 1692 - DNA, 1311 bp, Homo sapiens
atgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatga

SEQ ID NO: 1693 - DNA, 524 bp, Homo sapiens
tgacacttgactccttgcctacatctatagcttggcacagagagattcacgcaccctcaagagtgtgggtgagacatatacagcctgttagacctgaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttgga

SEQ ID NO: 1694 - DNA, 1766 bp, Homo sapiens
gggcctcattgctgcagacgctcaccccagacactcactgcaccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccacctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagaggctctgtttaaaatgtctttggactcccagggctgagtgggctgggatctcgtgtcctcaa

SEQ ID NO: 1695 - DNA, 1434 bp, Homo sapiens
attgtgcttggccaatgcctcttctgaagcagccatcccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 1696 - DNA, 1356 bp, Homo sapiens
atgtggggcttatgggaagaggtgaagcaggacagagattagggttgggagacattcagaggcttgggcacaaggagagacctggactggggcaggacactctcctatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtgggtgagtgcgggtccccacccctgtgcgctctgcaccctcaagaccctgtccctccagtaaaccacctgcgaattgaaaaggtagctaacagagggcattccagtggtagaactccaggcggtttcctgaaatcttaggaattccacctttggatgtggaggacctcgggcaaatcattttcttcctgtgggccccagtttccccatctgtcaacgagggatgaggtgttctagatgagcagggccctctggctcagcagtctcatgtatgtctgatcagcagtcacaagggtttctcaagttccatgcctctctccactccacagcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtaggcagccctgca

SEQ ID NO: 1697 - DNA, 1307 bp, Homo sapiens
atcatttttttttctctattaggggaggagcccgtcctggcactcccattggcctgtagattcacctcccctgggcagggccccaggacccaggataatatctgtgcctcctgcccagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagca

SEQ ID NO: 1698 - DNA, 1711 bp, Homo sapiens
tgtttgcttttccagggctgatgtttgcagggtgtttttttttttcttttgaaccaaagcagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcatggtgttccaaacacagcccgtgagctcacagccccaaccagaaggtgccaatgaagcagtccccacacccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 1699 - DNA, 1583 bp, Homo sapiens
tgtttgcttttccagggctgatgtttgcagggtgttttttttttcttttgaaccaaagcagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcatggtgttccaaacacagcccgtgagctcacagccccaaccagaaggtgccaatgaagcagtccccacacccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctct

SEQ ID NO: 1700 - DNA, 4844 bp, Homo sapiens
gaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacaatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 1701 - DNA, 623 bp, Homo sapiens
atacaagagatgtgagaagcaccataaaaggcgttgtgaggagttgtgggggagtgagggagagaagaggttgaaaagcttattagctgctgtacggtaaaactccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcag

SEQ ID NO: 1702 - DNA, 4563 bp, Homo sapiens
agggtacaatacgtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacaatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaata

SEQ ID NO: 1703 - DNA, 5274 bp, Homo sapiens
gtccaccacctaacctggtggttacagaaggaggaacacagtcctcctgtgttccaggtgccaggaggtgactgactatagcatcagtcatcactgcacaccctacctggaattagtatataaagctacgcggagcgatctctgcccctgaccctggaaaaatctgtctcacccacaaagatgtgggctcagctccttctaggaatgttggccctatcaccagccattgcagaagaacttccaaactacctggtgacattaccagcccggctaaatttcccctccgttcagaaggtttgtttggacctgagccctgggtacagtgatgttaaattcacggttactctggagaccaaggacaagacccagaagttgctagaatactctggactgaagaagaggcacttacattgtatctcctttcttgtaccacctcctgctggtggcacagaagaagtggccacaatccgggtgtcgggagttggaaataacatcagctttgaggagaagaaaaaggttctaattcagaggcaggggaacggcacctttgtacagactgacaaacctctctacaccccagggcagcaagtgtatttccgcattgtcaccatggatagcaacttcgttccagtgaatgacaagtactccatggtggaactacaggatccaaatagcaacaggattgcacagtggctggaagtggtacctgagcaaggcattgtagacctgtccttccaactggcaccagaggcaatgctgggcacctacactgtggcagtggctgagggcaagacctttggtactttcagtgtggaggaatatgtgctgccgaagtttaaggtggaagtggtggaacccaaggagttatcaacggtgcaggaatctttcttagtaaaaatttgttgtaggtacacctatggaaagcccatgctaggggcagtgcaggtatctgtgtgtcagaaggcaaatacttactggtatcgagaggtggaacgggaacagcttcctgacaaatgcaggaacctctctggacagactgacaaaacaggatgtttctcagcacctgtggacatggccacctttgacctcattggatatgcgtacagccatcaaatcaatattgtggctactgttgtggaggaagggacaggtgtggaggccaatgccactcagaatatctacatttctccacaaatgggatcaatgacctttgaagacaccagcaatttttaccatccaaatttccccttcagtgggaagataagagttaggggccatgatgactccttcctcaagaaccatctagtgtttctggtgatttatggcacaaatggaaccttcaaccagaccctggttactgataacaatggcctagctccctttaccttggagacatccggttggaatgggacagacgtttctctggagggaaagtttcaaatggaagacttagtatataatccggaacaagtgccacgttactaccaaaatgcctacctgcacctgcgacccttctacagcacaacccgcagcttccttggcatccaccggctaaacggccccttgaaatgtggccagccccaggaagtgctggtggattattacatcgacccggccgatgcaagccctgaccaagagatcagcttctcctactatttaatagggaaaggaagtttggtgatggaggggcagaaacacctgaactctaagaagaaaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtttcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggaccttttcagctttttccgggacgtgggcctgaaaatactgtccaatgccaaaatcaagaagccagtagattgcagtcacagatctccagaatacagcactgctatgggtgcaggcggtggtcatccagaggcttttgagtcatcaactcctttacatcaagcagaggattctcaggtccgccagtacttcccagagacctggctctgggatctgtttcctattggtaactcggggaaggaggcggtccacgtcacagttcctgacgccatcaccgagtggaaggcgatgagtttctgcacttcccagtcaagaggcttcgggctttcacccactgttggactaactgctttcaagccgttctttgttgacctgactctcccttactcagtagtccgtggggaatcctttcgtcttactgccaccatcttcaattacctaaaggattgcatcagggttcagactgacctggctaaatcgcatgagtaccagctagaatcatgggcagattctcagacctccagttgtctctgtgctgatgacgcaaaaacccaccactggaacatcacagctgtcaaattgggtcacattaactttactattagtacaaagattctggacagcaatgaaccatgtgggggccagaaggggtttgttccccaaaagggccgaagtgacacgctcatcaagccagttctcgtcaaacctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggctgacagcgtttgtcacaaaatgctttggccaagctcagaaattcatcttcattgatcccaagaacatccaggatgctctcaagtggatggcaggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacacaatgcatatgggggcttctcttctactcaggatactgtagttgctctccaagctcttgccaaatatgccactaccgcctacatgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggataggagctggaaactcaattagtcctctgtgacatttactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatgggcagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaagattagcctggtgtggtggcacgggcctgtaatcgcagccccttggaaggccaaggcaggagaatcgcctcaacactggaggtggaggttgcagtgagctgagattgtgccactgcactccagcctgggcaatgaggcaagaccctgtctcaaaaaataataaataataataataataatgtttttctagagtttcagtctaagggaaaatgtgatttagggctttggaaattggctaaaaaaataaaaatggaaaagaaaatc

SEQ ID NO: 1704 - DNA, 5190 bp, Homo sapiens
atcagtcatcactgcacaccctacctggaattagtatataaagctacgcggagcgatctctgcccctgaccctggaaaaatctgtctcacccacaaagatgtgggctcagctccttctaggaatgttggccctatcaccagccattgcagaagaacttccaaactacctggtgacattaccagcccggctaaatttcccctccgttcagaaggtttgtttggacctgagccctgggtacagtgatgttaaattcacggttactctggagaccaaggacaagacccagaagttgctagaatactctggactgaagaagaggcacttacattgtatctcctttcttgtaccacctcctgctggtggcacagaagaagtggccacaatccgggtgtcgggagttggaaataacatcagctttgaggagaagaaaaaggttctaattcagaggcaggggaacggcacctttgtacagactgacaaacctctctacaccccagggcagcaagtgtatttccgcattgtcaccatggatagcaacttcgttccagtgaatgacaaggtgagttgggaggagggacaggatccaaatagcaacaggattgcacagtggctggaagtggtacctgagcaaggcattgtagacctgtccttccaactggcaccagaggcaatgctgggcacctacactgtggcagtggctgagggcaagacctttggtactttcagtgtggaggaatatgtgctgccgaagtttaaggtggaagtggtggaacccaaggagttatcaacggtgcaggaatctttcttagtaaaaatttgttgtaggtacacctatggaaagcccatgctaggggcagtgcaggtatctgtgtgtcagaaggcaaatacttactggtatcgagaggtggaacgggaacagcttcctgacaaatgcaggaacctctctggacagactgacaaaacaggatgtttctcagcacctgtggacatggccacctttgacctcattggatatgcgtacagccatcaaatcaatattgtggctactgttgtggaggaagggacaggtgtggaggccaatgccactcagaatatctacatttctccacaaatgggatcaatgacctttgaagacaccagcaatttttaccatccaaatttccccttcagtgggaagataagagttaggggccatgatgactccttcctcaagaaccatctagtgtttctggtgatttatggcacaaatggaaccttcaaccagaccctggttactgataacaatggcctagctccctttaccttggagacatccggttggaatgggacagacgtttctctggagggaaagtttcaaatggaagacttagtatataatccggaacaagtgccacgttactaccaaaatgcctacctgcacctgcgacccttctacagcacaacccgcagcttccttggcatccaccggctaaacggccccttgaaatgtggccagccccaggaagtgctggtggattattacatcgacccggccgatgcaagccctgaccaagagatcagcttctcctactatttaatagggaaaggaagtttggtgatggaggggcagaaacacctgaactctaagaagaaaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtttcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggaccttttcagctttttccgggacgtgggcctgaaaatactgtccaatgccaaaatcaagaagccagtagattgcagtcacagatctccagaatacagcactgctatgggtgcaggcggtggtcatccagaggcttttgagtcatcaactcctttacatcaagcagaggattctcaggtccgccagtacttcccagagacctggctctgggatctgtttcctattggtaactcggggaaggaggcggtccacgtcacagttcctgacgccatcaccgagtggaaggcgatgagtttctgcacttcccagtcaagaggcttcgggctttcacccactgttggactaactgctttcaagccgttctttgttgacctgactctcccttactcagtagtccgtggggaatcctttcgtcttactgccaccatcttcaattacctaaaggattgcatcagggttcagactgacctggctaaatcgcatgagtaccagctagaatcatgggcagattctcagacctccagttgtctctgtgctgatgacgcaaaaacccaccactggaacatcacagctgtcaaattgggtcacattaactttactattagtacaaagattctggacagcaatgaaccatgtgggggccagaaggggtttgttccccaaaagggccgaagtgacacgctcatcaagccagttctcgtcaaacctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggctgacagcgtttgtcacaaaatgctttggccaagctcagaaattcatcttcattgatcccaagaacatccaggatgctctcaagtggatggcaggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacacaatgcatatgggggcttctcttctactcaggatactgtagttgctctccaagctcttgccaaatatgccactaccgcctacatgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggataggagctggaaactcaattagtcctctgtgacatttactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatgggcagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaagattagcctggtgtggtggcacgggcctgtaatcgcagccccttggaaggccaaggcaggagaatcgcctcaacactggaggtggaggttgcagtgagctgagattgtgccactgcactccagcctgggcaatgaggcaagaccctgtctcaaaaaataataaataataataataataatgtttttctagagtttcagtctaagggaaaatgtgatttagggctttggaaattggctaaaaaaataaaaatggaaaagaaaa

SEQ ID NO: 1705 - DNA, 3370 bp, Homo sapiens
agcttccttggcatccaccggctaaacggccccttgaaatgtggccagccccaggaagtgctggtggattattacatcgacccggccgatgcaagccctgaccaagagatcagcttctcctactatttaatagggaaaggaagtttggtgatggaggggcagaaacacctgaactctaagaagaaaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtttcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggaccttttcagctttttccgggacgtgggcctgaaaatactgtccaatgccaaaatcaagaagccagtagattgcagtcacagatctccagaatacagcactgctatgggtgcaggcggtggtcatccagaggcttttgagtcatcaactcctttacatcaagcagaggattctcaggtccgccagtacttcccagagacctggctctgggatctgtttcctattggtaactcggggaaggaggcggtccacgtcacagttcctgacgccatcaccgagtggaaggcgatgagtttctgcacttcccagtcaagaggcttcgggctttcacccactgttggactaactgctttcaagccgttctttgttgacctgactctcccttactcagtagtccgtggggaatcctttcgtcttactgccaccatcttcaattacctaaaggattgcatcagggttcagactgacctggctaaatcgcatgagtaccagctagaatcatgggcagattctcagacctccagttgtctctgtgctgatgacgcaaaaacccaccactggaacatcacagctgtcaaattgggtcacattaactttactattagtacaaagattctggacagcaatgaaccatgtgggggccagaaggggtttgttccccaaaagggccgaagtgacacgctcatcaagccagttctcgtcaaacctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggctgacagcgtttgtcacaaaatgctttggccaagctcagaaattcatcttcattgatcccaagaacatccaggatgctctcaagtggatggcaggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacacaatgcatatgggggcttctcttctactcaggatactgtagttgctctccaagctcttgccaaatatgccactaccgcctacatgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggatctggctctgttgcccaggctgcagtgcagtggcgtgatctcagctcactgcagcctctgcctcccaagttcaagcgattcttgtgcctcagcctcctgagtagctgggatgacaggcacgtgccatcacgcccagctaattttttttgtatttttaatagagatggggtttcgccatgttggtcaggctggtctcaaactcctggcctcaggtgatccgcctacttcagcctcccaaagtgctgggattacaggtgtaagccactgtgcccggcctgtcctaaactcttgaaaatagtttacagaagaaaaagctaatgcttggtattaaaacaatacttttttctatcag

SEQ ID NO: 1706 - DNA, 2484 bp, Homo sapiens
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaactttccaagccataactgttactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgtttccttttccaagtttgcttatttatgaaaagttatcgataatttctttagttttgtataccattgtctgaagcagattctgttaaaatagcattaagtgttggttattataggagattaaagctatccaaggatggatttacagcactagatcacttggtgaactgaaaaatgttcccaagttaaacactatttgatgctaccagggcattttgtttattaaatgaccatcactgaagtattctaacagataatctggagatgagaaaagaaattattattcttctatgggatctaagaaaatttaacatctactttttttctcaatcttgttcagttctctattcacagacattttaaaacataagaatattacagttttgattgaatataattaa

SEQ ID NO: 1707 - DNA, 4537 bp, Homo sapiens
tttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatggtgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcattcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatatgggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcatggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataattttatatgtagttgaattcatcaatcttttattttgtatggctttttggttatgtataatacttagatcctccttatactctgagtttctttctttttaattctcctgtatttccttctagtataattaaatctgtaaaaagt

SEQ ID NO: 1708 - DNA, 1336 bp, Homo sapiens
tttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaaagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggatcccatccagccaaacactcaatgtagtgggatgtcagaagcaagagaagacccacaaggccaggcactatggctcatgcctgtaatcccagcactttgggaggccgaagcgggtggatcacctgaagtcaggagttcgagaccagcctggacaacatgatgaaaccccatctctactgaaaactacaaaaattagccaggcgtggtggcagccgcctgtaatcccagctacttaggaggctgaggcaggagaatcacttgaactccggaggtggaagttgcagtgaggtgagatcaaatgcaaaactatactctagagaagtatccacacccagggccatgggaatctcacaggaaaatattcttggctaaagatgaccttacattaaaattataagcaacaggctgggcagcggctcacgcctgtaaacccagcattttgggaggccaaggcgggtggattacctgaagtcaggagttcgagaccagcctggctaacatggtgaaaccccatctctattaaaaatacaaaaaattagcctggtgtggtggcaggcgcacgaaatcccagctacttgggaggctgaggcgggagaattgcttgaacccagaaggcagaggttgcagtgagctgagatcatgccattgcactccagcctgggttacagtgagactctgtctc

SEQ ID NO: 1709 - DNA, 5410 bp, Homo sapiens
aattcctacttcctgaaactgaagccgtttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatggtgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcattcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatatgggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcatggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataattttatatgtagttgaattcatcaatcttttattttgtatggctttttggttatgtataatacttagatcctccttatactctgagtttctttctttttaattctcctgtatttccttctagtataattaaatctgtaaaaagtaagatggaagagtggtacagttttctttatccagtctgtccttgatgggcatttaggtagactggataaagaaaatgtggtacatatacaccatggaacactatgtgtattaatccactctcacactgctatgaagagatacctgagactgggtaatttagaaagaaaagaggtttaattaactcacagttccacatggctggggagacctcaggaaacttacaatcatggcagaaggcacctcttcatagggtagcaggagagagaatgagtgccagcaggggaaatgccagatgcttataaagccatcagatcttgtgagaattcattcactctcacgagaacagcatgggaaaaactgcctcaattacctcctaccaggtccttcccatgacacatgggaattatgggactacaattcgagatgagatttgggtggggacacaaagccaaaccatatcacaatgtaaccataaaaaagaatgagatcatgtcctttgcagggacatggatagagctggaggccattatttttagcaaactaatgcaagaacagaaaactaaataccacttgttctcacttataggtgagagctaagtgatgagagtaggtggacacatagagggaacaacacacaccagggcttatcagagggtggacagtgggaggagggagaggatcaggaaaaataactaatgggtactaggctgaatacctgggtgatgaagtaattcgcacaacaaacccccatgacacaaacctgcacatgtacccctgaacttaaaataaaagt

SEQ ID NO: 1710 - DNA, 3931 bp, Homo sapiens
acagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagaggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatggtgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcattcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatatgggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcatggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaaga

SEQ ID NO: 1711 - DNA, 4153 bp, Homo sapiens
ggcgccggggattgggagggcttcttgcaggctgctgggctggggctaagggctgctcagtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggcgatctgacacagctaatgatttgaagaagggtgtgacctgccaccattttaaatctagttatttcactcctgagctgtgtgtgtggaaaacttgtagtaaaaaatagaatgtctatatttataaaaa

SEQ ID NO: 1712 - DNA, 2919 bp, Homo sapiens
ctgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccagg

SEQ ID NO: 1713 - DNA, 786 bp, Homo sapiens
ggggcgtggcgccggggattgggagggcttcttgcaggctgctgggctggggctaagggctgctcagtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 1714 - DNA, 1195 bp, Homo sapiens
ggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataaa

SEQ ID NO: 1715 - DNA, 5504 bp, Homo sapiens
gcgcgcggggcagccgcgtggctaggcagacggggccgggagcggcgcgcgcgcgccccgccagcctctggcgcgcccccggcggcctgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtactttgctttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccga

SEQ ID NO: 1716 - DNA, 3380 bp, Homo sapiens
ctctttctctgggctaatcgtttagaggacagtcgctcctgccaacctaatcccatgagcctgactaccttgccgggccacaggctcaaagaagcagtgtggctgccagcaccctcacggtaaggggcacggaggcaccaggcagtctggcaggatgagagacatcctgggggtggtctgagtttggatgtgggctgagaagacaaagcagggggctttcgggggacaagattttccaaacatcttattcttaggatcatcacttcctaatctgatgcaactgactcggcaggcattcgggagcctgtaagctccattttcctgttccaaattcttctgcacctcaccatgagtcctcaccttgaccctaatcaacttgggattctcctcaaagtacttagaaaggaaaaggaagacggtgactaccctgacatgatggccacccacccgagctccaggtatgaagcctgctcctctggaattactctagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaac

SEQ ID NO: 1717 - DNA, 3052 bp, Homo sapiens
agactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctatgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaa

SEQ ID NO: 1718 - DNA, 4741 bp, Homo sapiens
gggggtgcgagcgaggagccgcacaggcagtcccggcgcggggcaaccacagcgctcaggaggccctgagtccggcacctggccatgtgcaaccctgaggaggcagctctgctgcggctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaaggcagcaaagaggagaagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggagcatcacccaacccgggagctggtggtgaacgcagtcaccctctttgggaacctgcagtccttcatgaagcaggagttggaccaggctgtggccacacaggctctctggcacaccctgagaggccggctgagggatgtgctctgcacccctgctcacagactccttcaggacagccaggacgtacccgtgacggtcgcaccgttgcgggctgagcgtgtgctgctctttgatgatgccctcgtcctgctgcagggccacaatgtccacacctttgatctgaagctggtgtgggtggatcctgggcaggacgggtgcacgtttcacctcctcacgcccgaagaagagttctccttttgtgccaaggactcccagggccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggcaagggaaccctgaaatggccggatgggcggaatcacgtggggaatttctgccagggcctggagcatggcttcggcatccgcctgctgccccaggcctctgaggacaagttcgactgttacaagtgtcactggcgagaaggcagcatgtgtggctacggcatctgtgagtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacagaggtgagcgctacattggcatgtggcaggctggtcagcgccacggcccaggggtcatggtcacccaggcaggtgtctgctaccagggcaccttccaggcggacaagacggtgggcccgggcatcctcctctctgaagacgactccctgtatgagggcaccttcaccagggacctgaccctcatggggaagggcaaggtcaccttccccaatggcttcaccctggagggctcgttcggcagtggggcagggagaggactgcacacacagggtgtgctggacacggctgccctcccaccagacccgagcagtacctgcaagaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttggaaaactgactttagtctgctgggctgtattgacctctggcaggctcgaagcctcactgggtatgcagtcaacaggatgggcctggagatccgtgaactgcaggccacgtacccatgacgtaaacggcggcactggagcaagctggggcggggggtgggtaaaccctcactgccagcaggccccaagtggcttgtaaatcattctcctgtgatgtctgtgggcctgcgtggggacaacaggggcacatgacatctgcctgggccctgaccaataaaccctcagacccaggacccaggaccctgctgtagttggggagcaggagtacctttgggaggggaggactttatttaaacagtggttctagtgtgggaccaagagaggcaggagctgggtcttggggcagctttattcctgttgggcctcagtttctcttccccacacagtttatcttccgtcacattgtgccgggtgacgtgcacggtctccctctgccctagccggagatgcatgatgacaggcagtgtgatgtgttctgaaagtgtccagggcaaagcgtagggagagggtggatttgtgcagggtgcagctctggagaagaagctggatcactcttggtcccattccctaggccctgagcaagtcaggctcctggctctgggtgtggctcccccaaacgaagtactgacttcagcctgtgaggggagggttgagggaggctctggaaagcccagccacacctgagtccctggcagtagccttggggcagagggcacccgcagagtcccagagatgatgtgggcagtgggcagagagagccttggcgcctctgtttgccaccacttccccaggaaggagggacagcatttctctggctggttccactaaatgtgccagcccaaatgcagggcatgggctctggttctgccaggagcctgtgacacccccaggaagggggtggaactgaggaagagcgaggatatgcaggcactcatgcttaccgggactggggcagctcactaggattctatcctttccaatcggcatcagccagctcttgtcccctgataagtgaggacagcctgaccctggcctcaaatgcagccatccctgagttcatgcgatgctgacgggaccccagcacacttccctgcctcctttgagatctgcgagcccttgctgcagttcagattcaacaaggccctctgcccaccctctcactaggcctcacccaacaccagtggaactggagcctctggctgggcacagtggctcactttgggaggctgaggcaggaaggctgctggaaactgagagttcaagaccagcctgggcaacatagtgagaccctgtctctacaaatacaaaataaaataattagctggg

SEQ ID NO: 1719 - DNA, 1747 bp, Homo sapiens
aggaaggaaccagctgtaagggagggcagagggggatgtcttggaggggaatcccagactttggacactggtctctcttggaccaagaccccctctctggcttggcctccagatctgcccacctttctgtctccgtctttccaggattccatatgcttctgtctgtcttctcgtcgcagggtagattctctgtccctttctctgctgctcttcctcctggagccgtggaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttgg

SEQ ID NO: 1720 - DNA, 3471 bp, Homo sapiens
acagcgctcaggtaagggcgcgacgaagggcgcgcgtctgcggacgggtgtctgcgctccacgcttagctcgtccaggtgggggctcccgcctcctcggctgctgcggtccccgcccagctccttggtcccggcggcagtcatcccccggccgtccgagtccctcgaggccctgagtccggcacctggccatgtgcaaccctgaggaggcagctctgctgcggctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaaggcagcaaagaggagaagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggagcatcacccaacccgggagctggtggtgaacgcagtcaccctctttgggaacctgcagtccttcatgaagcaggagttggaccaggctgtggccacacaggctctctggcacaccctgagaggccggctgagggatgtgctctgcacccctgctcacagactccttcaggacagccaggacgtacccgtgacggtcgcaccgttgcgggctgagcgtgtgctgctctttgatgatgccctcgtcctgctgcagggccacaatgtccacacctttgatctgaagctggtgtgggtggatcctgggcaggacgggtgcacgtttcacctcctcacgcccgaagaagagttctccttttgtgccaaggactcccagggccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggcaagggaaccctgaaatggccggatgggcggaatcacgtggggaatttctgccagggcctggagcatggcttcggcatccgcctgctgccccaggcctctgaggacaagttcgactgttacaagtgtcactggcgagaaggcagcatgtgtggctacggcatctgtgagtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacagaggtgagcgctacattggcatgtggcaggctggtcagcgccacggcccaggggtcatggtcacccaggcaggtgtctgctaccagggcaccttccaggcggacaagacggtgggcccgggcatcctcctctctgaagacgactccctgtatgagggcaccttcaccagggacctgaccctcatggggaagggcaaggtcaccttccccaatggcttcaccctggagggctcgttcggcagtggggcagggagaggactgcacacacagggtgtgctggacacggctgccctcccaccagacccgagcagtacctgcaagaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttggaaaactg

SEQ ID NO: 1721 - DNA, 12922 bp, Homo sapiens
aggcgggcggcactgcgcctaagctgggccacaaccgccagtcagggctctccccttcccctccctccccccctcctcctcctcctctgccgcccagagcgagacaccaacatggagcccgaggatctgccatggccgggcgagctggaggaggaggaggaggaggaggaggaggaggaggaggaagaggaggaggctgcagcggcggcggcggcgaacgtggacgacgtagtggtcgtggaggaggtggaggaagaggcggggcgggagttggactccgactctcactacgggccccagcatctggaaagtatagacgacgaggaggacgaggaggccaaggcctggctgcaggcgcaccccggcaggattttgcctccgctgtcgcccccgcagcaccgctactcggagggcgagcggacctccctggagaagattgttccattgacctgtcatgtatggcaacagatagtatatcaaggcaatagtagaacacaaatttctgatactaatgtggtctgtttggaaacaacagctcagcggggttctggggatgatcagaaaacagaatcttggcattgtcttcctcaagaaatggactcttcccaaaccttggatacatcccagactaggtttaatgtgagaacggaagatactgaagtgacagacttcccctctctggaggagggcatattgacgcaatcagaaaatcaagtaaaggaacccaacagagatctcttctgttctccactgctagtcatacaagatagctttgcttctcctgatttgcctttgctgacctgtttgacacaagaccaagaatttgcgcctgattctttatttcatcaaagtgaactaagttttgcacctctgaggggaattcctgataagtctgaagatactgaatggtcttctcgaccatcggaagttagtgaagctttattccaggctactgcagaagtagcttcagacttagcaagcagtcgctttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccaagggcctgcaggggaaggttgagtctgacgtcattactctggatggcctaaatgaaaatgctgttgtatgcagtgaaagagttgctgaactacaaagaaagccaacaagagagtcggaatatcactcttcagatctcagaatgttgaggatgtctcctgacactgtgccaaaggctcctaaacatttaaaagcaggagacacttctaaaggaggcatagctaaagttactcaatccaacttgaagtcaggcatcactaccactcctgttgattcagacattggatctcatttatccttgtcccttgaggacctgtctcagttggctgtaagttctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatgtagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagttcgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactc

SEQ ID NO: 1722 - DNA, 7797 bp, Homo sapiens
aggcgggcggcactgcgcctaagctgggccacaaccgccagtcagggctctccccttcccctccctccccccctcctcctcctcctctgccgcccagagcgagacaccaacatggagcccgaggatctgccatggccgggcgagctggaggaggaggaggaggaggaggaggaggaggaggaggaagaggaggaggctgcagcggcggcggcggcgaacgtggacgacgtagtggtcgtggaggaggtggaggaagaggcggggcgggagttggactccgactctcactacgggccccagcatctggaaagtatagacgacgaggaggacgaggaggccaaggcctggctgcaggcgcaccccggcaggattttgcctccgctgtcgcccccgcagcaccgctactcggagggcgagcggacctccctggagaagattgttccattgacctgtcatgtatggcaacagatagtatatcaaggcaatagtagaacacaaatttctgatactaatgtggtctgtttggaaacaacagctcagcggggttctggggatgatcagaaaacagaatcttggcattgtcttcctcaagaaatggactcttcccaaaccttggatacatcccagactaggtttaatgtgagaacggaagatactgaagtgacagacttcccctctctggaggagggcatattgacgcaatcagaaaatcaagtaaaggaacccaacagagatctcttctgttctccactgctagtcatacaagatagctttgcttctcctgatttgcctttgctgacctgtttgacacaagaccaagaatttgcgcctgattctttatttcatcaaagtgaactaagttttgcacctctgaggggaattcctgataagtctgaagatactgaatggtcttctcgaccatcggaagttagtgaagctttattccaggctactgcagaagtagcttcagacttagcaagcagtcgctttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccaagggcctgcaggggaaggttgagtctgacgtcattactctggatggcctaaatgaaaatgctgttgtatgcagtgaaagagttgctgaactacaaagaaagccaacaagagagtcggaatatcactcttcagatctcagaatgttgaggatgtctcctgacactgtgccaaaggctcctaaacatttaaaagcaggagacacttctaaaggaggcatagctaaagttactcaatccaacttgaagtcaggcatcactaccactcctgttgattcagacattggatctcatttatccttgtcccttgaggacctgtctcagttggctgtaagttctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatgtagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagttcgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaaggggttgcaatcctag

SEQ ID NO: 1723 - DNA, 2028 bp, Homo sapiens
aaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcagccccagcttggtgaccgggtggctccattcaccctgggtccctcgctgaaacggtgcctgggaccagagcagagaacacgcttgccagtggtaggagatggaggcgacgtggactctgggaggcttcttttttggggtccatccagaggccgagcctctccaagcactggtcagcctccatgccacccagtctgccgaccctcctctccaccatcccctcgtccgagcagtggcgatccctcccgagtcaaggctgggcacaagcacgtggggacaggccgggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 1724 - DNA, 1841 bp, Homo sapiens
gctgcggccccgccccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 1725 - DNA, 1283 bp, Homo sapiens
aaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaagagacggagtctctctctgtcgcccaggctggagtcagtggtgccatctcagctcactgcaagctccgcctcccgggttcaagtggttctcctgcctcagcctcccaagtag

SEQ ID NO: 1726 - DNA, 1445 bp, Homo sapiens
gtattaaagggaccggagcggggcagttcccgacgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcgtgaactatgggatcactaaagtagaaggacagccccttcacaccgaactgaatagagctatggacaactgtaacagtctccgaatgtctcccgtgaaagggatgcaagagaagggagagctggatgaacttggggataaatgtgatagcaatgtatccagcagtaagaaacggaggcaccgaaccaccttcaccagtttgcagctagaggagctggagaaagtctttcagaaaactcattacccggatgtgtatgtcagagaacagcttgctctgaggacagagctcactgaggccagggtccaggtttggtttcaaaatcgaagggccaaatggagaaaaagggaacgttatggccaaatacaacaagcgaaaagccattttgctgccacctatgatatatcagttttgccaaggactgacagctacccacagattcagaacaatttgtgggcaggaaatgcaagtggtggttctgtggttacttcatgcatgttaccacgtgacacttcctcctgtatgacaccttattctcactcgcctcggacagattccagttacacggggttttcaaaccaccagaaccagttcagccacgtgcccctcaacaattttttcactgactctcttcttactggggcaaccaatggacatgcatttgaaacaaagccagagtttgaaaggaggtcttccagtatcgcagttcttcgaatgaaagccaaggagcacaccgccaatatttcatgggccatgtaacatacagtactcttttatttttcttttaatagcaaagttaaacattcttatttctcatatttaaaggataccacaataagctgctgtgtgtggaattgctaaaggtcaagatattcagtgagaccagcttaaatgaatagttgttatttaacattaaaatctaagaatgaacctctgaaaagactaaataggtttaccatgtgccagtctccacaaaccctgttttagtagtaaggttttctttttctattgtacaagtcaatgaaatatgatcacgcaacttattaaagaataaatgtgttaaacaaa

SEQ ID NO: 1727 - DNA, 1771 bp, Homo sapiens
atggaccccgagcactgcgcgcctttccgcgtggggcctgcacccggcccctatgtggcctcgggggacgagcctccgggcccgcagggaacccccgccgctgcgcctcacctgcaccccgcgccgccccgcggcccgcggctgacccgctttccggcctgcgggcccctggagccctacctcccagagccggccaagccgcccgccaagtacctgcaggacctcgggcccggcccggccctcaacggcggccacttctacgagggccccgcggaagctgaggagaagacctccaaagctgccagcttcccccagctgcccttggactgccgagggggccccagagacgggccctctaacttgcaaggctccccaggcccctgcctggccagcctgcatcttcctctttccccgggactccctgactccatggagttggccaagaacaagagcaagaagcgtcgtaaccgcacgaccttcagcacattccagctggaggagctggagaaggtcttccagaaaacccactatcctgatgtgtatgcccgggagcagctggccctgcgcacagacctgactgaggcccgggtacaggtctggttccagaaccgcagagccaagtggcggaagcgcgagcgttatgggaagatccaggaggggcggaaccccttcacggctgcctatgacatctctgtgctgccccgtactgacagccaccctcagctgcagaactccctgtgggccagtccaggatctgggagccctggaggcccctgccttgtgtctccagagggcatcccctccccatgcatgtctccatattcccacccccatgggagtgtggctggcttcatgggggtgccagccccttctgcggctcaccctggcatctactccatccatggctttccccccaccctggggggccacagctttgagccttcctcagatggtgactataagtctccaagcctcgtctcgctcagggtaaagcccaaggagccacccggccttctgaactggaccacgtgatcggttgcatggacctgcagaatgagctgcccacctctttttccattcccagtcgctcccagcccacctctgcctccaagccccagatggttctggaggctgcgagagcagctggcactgtcagcccccagcagggaacacgttacagggtcttttctcttagaacaaggtggggctgcctaggagaaggggcttcgaagcagccaggactcttcctaccacaaactgagtcccctcacctgaactctgggctggaggcagggagacactgccctgcttcctccagactttgtccaagtccattgtcatctctccagctaagacagcttacttggctcatcgttcagggaacccaggaaaatgggaggagaacgccgcgtggactgaagctcttcatgatgagatggaaaccaaaagggagtctcccatgatggggtggagtcagccctgcttcccctccccaccagcagggggcgcactggtgtctgacactaaggagggtgtaaaggccaaggtcagcatagactgaggcacactggctcctcagctccagccaccctcactcctgccatgtgcctgcactcccagcatgccatgcagtcatcttcccctccaagggggcagaaattccaccagaaatcaccacatatttggaatctcttccacgggaccagcccagagctatgccatggaaatgatattggatgttggtaagaataaaacagatttctacagactg

SEQ ID NO: 1728 - DNA, 5750 bp, Homo sapiens
gcacagccacagcctcctcgcctccccaaactcccagccaaggcgcgcggtggcgtcctcgcgccctcgctcgcgtccccgcccgccgcctgcgcaagccaggcatgaatgctgagacttgcgtctcttactgcgagtcgccggccgctgccatggacgcctactacagcccggtgtcgcagagtcgggagggctcgtcgccttttagggcatttcccggaggcgacaagttcggcacaactttcctgtcggccgccgccaaagcacagggattcggggacgccaagagccgggcccgttacggcgctgggcagcaggacctggcgacacccctggagagtggagctggggcgcggggctcctttaacaagttccagccccagccgtcgaccccgcagccccagccgccgccgcagccgcagccgcagcagcagcagccgcagccccagccgcccgcgcaaccgcatctttacttgcagcgaggcgcctgcaagacgcccccggacggcagcctcaaactccaggaaggcagcagcggccacagcgcggccttgcaggttccctgctacgctaaagagagctccctgggtgagccagagttaccccctgactctgacactgtggggatggacagcagctacctgagtgtcaaggaggctggggtgaaggggccccaggaccgggccagctcagacctccccagcccattggagaaggccgactcagagagcaacaagggcaagaagcggcggaaccggaccaccttcaccagctaccagctggaggagctggagaaggtcttccagaagacccactacccagacgtgtatgcgcgggaacagctggccatgaggacagacctcactgaggcccgcgtgcaggtctggttccagaaccgaagggccaagtggaggaagcgggagcgttttgggcagatgcagcaggttcgaacccacttctccactgcatatgagctgcccctcctcacccgagctgagaactacgcccagattcagaacccgtcctggctcggcaacaacggggctgcctcaccagtgccagcctgcgtggtcccctgcgacccggtgcctgcctgcatgtcccctcatgcccacccccctggctctggggccagcagcgtcaccgacttcctgagtgtgtctggggctggcagtcacgtgggccagacgcacatgggcagcctgtttggagcagccagcctcagcccaggcctcaatggctacgagctcaacggcgagccggaccgcaagacctcgagcatcgcggccctccgcatgaaggccaaggagcacagtgcggccatttcctgggccacatgacagggcacccctgccccgtccccacctcgggacaccatgggccacgcccatgttttccaggcccccagcctcccactcgactttcctcttaggaacctggcctgggccaggggcctgaccctcagcactttcagccgccccaagtctgaggccccgtggactgctgggagggagggggcagcaggcccctggcccctccctggcactgaggccctgacccctgctcccggccacaggcagtggagaaagccaggtggccacgtttttcagcttcgcatccatgataagctgaaagcgctttcttgctcccgcccactcctctgctctgcctagttgaccatgagtcaatgctagatttccatgcagacccagcagcctcaccagcccagtcttgtccatccttcccgctcctagtggggtcccctggtcaccaggccggtggctgtgtgtctgaagcacaggctgccctgcagagccagcctcctgccctcccatctttctctccctgaaagcacacggaatccgacctgctggggccaaggcgccagcctccacctccccccgaacagtgacgagtctgacagagcctggctgactgcatcctggctgtcccctaggctggatacacctggagagagtgggcagaggatgacaggagctggagccgaggacccctgctgccatctagcaatgccagtccccaggggagacacgggccagcccctcactggacactataggggaggagccagacctgagggaggctgagaacacagatgccacaagggctcccatggtgctagaagaaggaaaggtcctgggagagggggaggcatccgggtggggcgtgggcccgggcagtcctcccgctctccggcctgcctggcatctggtacagcggggaggtctgggcagctttgttctccatccagagcccagtcaggttccctccaggaggatgcggaggggctcgtctcttccctgccctaccctggcccctccctggggctgctcagcagtgtcccggcatggaaggactcacaacttcggaacacataagctagagcttgggggccgggtggcagagggtcaaaagctgcgtgcaggctttgctagaggacgtgtggccatgctcggcctccaggccctgctatggcctcaaactgactgtcctccctgccatatctgtcagtgtcatcgctgcccagagccttccacggcagatgggggctctgtgtccctccaggcactaggaggtgttgctcttctccacacagctttccacactccgtccttacacttcttccacagggaccaggactctctgccctctctccagcctgcggaagggctcctggcctgggctcctcggtgtggctttgctattgcaaatggggctgtcaggatgccctcctgaaaccaggcttcctgcctccaggaagcggggctctgtgcctgcctgcccgacccctgtagcttgggtctggccctgagccccagccctcacctcagctgggagtacacagtaaccgtccagaggcaggcctgtcagaccccaggtggggggtccctccagcaggcagcgccccgcattgaagcgctcgccttttctaccttctcccttgattcctgtcatggagtagggccaggcccactatgctcagggtcgtggacacagaaaggcctcctgggttgggcggagggtaaacttggtgttgttgaatgagggtctctggggttgggggtgacagtctcccgcctgcctggtgttctcatctgctctagaaaccaggctgaggaagggtctggctgtggcctcccttaatgagtcagacctctttgtgaaccgtagctctaaaatggatcttatagaggtgaaagggtcttggacattgaattaaatgttcttggaggcttggctttaagtgtttcaaatatttgaggatttggagtgacttttgggaagttttttctagttctgaggttcgctgaaatgacccagactcccccaaaatctagccagggaaaggaagaacttaaggctgggaacagtttccccatttctcccccctttccttctgaaatgctcatggctgaggaaggatggggaaggaaggaactttcaccttgggtctttctcacccatgagagaatcaggacaaagaggaggagagccaggtagctccagagtgggccaggagggagagcaagggaatcaggacaaagaggaggacagacaggtagctccagagcaggcagggagggagagtgagagctttaagggggctcttccgcagtggcccccggcactcagttcctccatgcgtctgctctctggctgggctagacccaagtcaggcaaatttcaacccaaaagcttgagaagaaaaggcgtctattagaagactctgtggctatggctgcctgtcccaacacacccaggaagtgtctaggattaaacatgccaatgtgaaacattcctgttcatctcgtcaaaggcagccacgtaccccaggcctgtcctctgtggcttggcccagcccttgggggccacctaaccacactaagtatgataggaccaccgagttgggaggaagcttagaaaccctctagttagtccagtcccttcacaacagagaagaccctggcccagagtggagacatgactgccctgacctgtacttgccctgagactaggctgagagaggagcctgggacgtgccacccagggtgtgagggcctgggcttcgttggcaccaggggcggccggtgctgcatggagctcccctctccaatgcctcatgggcattcactcagcagctcagttctccagaagagaaccttggggcccagtcccttccaagacaggtggctaggcccaaccttctgcactgcagagcagggggccactgccgtgtcagctcctaggatgactgagcaagtcagggcagctgcccaaggccatctggagctaaagctcatgaaggcaggtggagagaagcatctacctgccacgtggttcattgctatgcgaataagctaagagaggtgaggatttcctttggatacctgcctaagatctcaacagagatggcaacttaaaaataaagtcgtgggtagccggcagatggatgggcagcctccccacactgacagcctccagtccctgctgggcacaggtctcagcatggcaaggcttgacactaaggtgctgctactgccctccagatgccagcactactcctggggcatgggagcgagggctctggggggcacacagagaggcttgtctccaaggctgaaatagcacttggaggacatgggcttttagaactttccttgaattcttttaactatacttgattctcagcgctcactaccgtgcctccagcttcgggaagcacggtggccaggttagctcaaagacactgcgatggggtaggtgcagcaagtgtggggtgggtccccagcacacacagctgtgatcacactggacccagctccgtgccccatctcctgtcatttcggctgggcagacgagggacgcttccatgaaaactacgtaccctgcttatgcagtcattccctccctgggctagacagtggggggccatcttcgagaacctgaaagacacgcgggggttcctggtctgtttcatggcccttactgtccagtgcaaaggcaaacaggcctagctgggggaggatggttggtaaactggcccccaggataatactctgtgactatccagttaaaaaataagaaggtgacaatgacccatcaaccccacttcacttctttcaggatgctgtagggaggaaaggtgcttccatgacctaacctcggcctctcctttcttccctcttcactcacacacatagagctaggcctttatactactgattttgaaggacagttttcaatgtctaatcatctgtttaggtgtgcagtggttgaaaaaagaaagctgagtgctagaaggaacatgaacctcaaccgttacttattgttctcattgtaagatattttaaccctgtataaatgcaacttttcctttagcttaatggcctggggtggaatattaaaaatatatattaaaaatacagtaaaaatccagaaaaatgtaaaaaaaaaaatgaggtcggttccataaagttttactgcctataccaccatgtaactacattatagcaaaatattaaaagaaacgttcttgccttttaaagtaagttattgcacttacatcttttttgggagaggaggaacacggatgggaaggagatgtaggggcccaggcatggggcaaaatggagtgcagaggtagccgggcactcccagaacaccctttgctggcccagcccaaactgtttggttgttgttatttgcaataaactccttctccttcctcc

SEQ ID NO: 1729 - DNA, 1037 bp, Homo sapiens
tttaaatttcttctacaaacacatacatcattgaagggtaaaatttttcaccagagtaaacttgagaaaccaactggaccttgagtattgtacattttgcctcgtggacccaaaggtagcaatctgaaacatgaggagtacgattctactgttttgtcttctaggatcaactcggtcattaccacagctcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggaggcatcctgcccaccagtcaggcaggggctaatccagatgtccaggatggaagccttccagcaggaggagcaggtgtaaatcctgccacccagggaaccccagcaggccgcctcccaactcccagtggcacagatgacgactttgcagtgaccacccctgcaggcatccaaaggagcacacatgccatcgaggaagccaccacagaatcagcaaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaactg
